(12) United States Patent
O'Neill et al.

(10) Patent No.: US 10,590,425 B2
(45) Date of Patent: Mar. 17, 2020

(54) THERAPEUTIC OLIGONUCLEOTIDES

(71) Applicant: Caris Science, Inc., Irving, TX (US)

(72) Inventors: Heather O'Neill, Mesa, AZ (US);
Mark Miglarese, Phoenix, AZ (US);
David Spetzler, Paradise Valley, AZ (US)

(73) Assignee: Caris Science, Inc., Irving, TX (US)

( * ) Notice: Subject to any disclaimer, the term of this patent is extended or adjusted under 35 U.S.C. 154(b) by 161 days.

(21) Appl. No.: 15/738,564

(22) PCT Filed: Jun. 29, 2016

(86) PCT No.: PCT/US2016/040157
§ 371 (c)(1),
(2) Date: Dec. 20, 2017

(87) PCT Pub. No.: WO2017/004243
PCT Pub. Date: Jan. 5, 2017

(65) Prior Publication Data
US 2018/0171337 A1 Jun. 21, 2018

Related U.S. Application Data

(60) Provisional application No. 62/305,536, filed on Mar. 9, 2016, provisional application No. 62/269,671, filed on Dec. 18, 2015, provisional application No. 62/239,226, filed on Oct. 8, 2015, provisional application No. 62/220,652, filed on Sep. 18, 2015, provisional application No. 62/198,110, filed on Jul. 28, 2015, provisional application No. 62/186,242, filed on Jun. 29, 2015.

(51) Int. Cl.
| | | |
|---|---|---|
| C12N 15/11 | (2006.01) | |
| C12N 15/115 | (2010.01) | |
| A61K 31/711 | (2006.01) | |
| A61K 47/68 | (2017.01) | |
| G01N 33/53 | (2006.01) | |

(52) U.S. Cl.
CPC .......... *C12N 15/115* (2013.01); *A61K 31/711* (2013.01); *A61K 47/6807* (2017.08); *G01N 33/53* (2013.01); *C12N 2310/16* (2013.01); *C12N 2310/3513* (2013.01); *C12N 2320/10* (2013.01); *G01N 2333/4716* (2013.01); *G01N 2333/70503* (2013.01); *Y02A 50/411* (2018.01)

(58) Field of Classification Search
None
See application file for complete search history.

(56) References Cited

U.S. PATENT DOCUMENTS

| | | |
|---|---|---|
| 4,551,435 A | 11/1985 | Liberti |
| 4,587,044 A | 5/1986 | Miller |
| 4,605,735 A | 8/1986 | Miyoshi et al. |
| 4,667,025 A | 5/1987 | Miyoshi |
| 4,762,779 A | 8/1988 | Snitman |
| 4,789,737 A | 12/1988 | Miyoshi |
| 4,795,698 A | 1/1989 | Owen et al. |
| 4,824,941 A | 4/1989 | Gordon |
| 4,828,979 A | 5/1989 | Klevan et al. |
| 4,835,263 A | 5/1989 | Nguyen et al. |
| 4,876,335 A | 10/1989 | Yamane et al. |
| 4,904,582 A | 2/1990 | Tullis |
| 4,925,788 A | 5/1990 | Liberti |
| 4,948,882 A | 8/1990 | Ruth |
| 4,958,013 A | 9/1990 | Letsinger |
| 5,082,830 A | 1/1992 | Brakel et al. |
| 5,108,933 A | 4/1992 | Liberti |
| 5,109,124 A | 4/1992 | Ramachandran |
| 5,112,963 A | 5/1992 | Pieles et al. |
| 5,118,802 A | 6/1992 | Smith et al. |
| 5,138,045 A | 8/1992 | Cook |
| 5,158,871 A | 10/1992 | Rossomando |
| 5,186,827 A | 2/1993 | Liberti et al. |
| 5,200,084 A | 4/1993 | Liberti et al. |
| 5,214,136 A | 5/1993 | Lin |
| 5,218,105 A | 6/1993 | Cook |
| 5,245,022 A | 9/1993 | Weis et al. |
| 5,254,469 A | 10/1993 | Warren |
| 5,258,506 A | 11/1993 | Urdea |
| 5,262,536 A | 11/1993 | Hobbs |
| 5,272,250 A | 12/1993 | Spielvogel |
| 5,292,873 A | 3/1994 | Rokita |

(Continued)

FOREIGN PATENT DOCUMENTS

| | | |
|---|---|---|
| EP | 0527905 | 2/1993 |
| EP | 1065378 | 1/2001 |

(Continued)

OTHER PUBLICATIONS

Avci-Adali et al., "Upgrading SELEX Technology by Using Lambda Exonuclease Diogestion for Single-Straded DNA Generation," Molecules, Jan. 2010, 15(1):1-11.

Brody and Gold, "Aptamers as therapeutic and diagnostic agents," Rev. Mol. Biotech., 2000, 74:5-13.

Bruno, "Aptamer-biotin-streptavidin-C1q complexes can trigger the classical complement pathway to kill cancer cells," In Vitro Cell Dev Biol—Animal, 2010, 46:107-113.

(Continued)

*Primary Examiner* — Ekaterina Poliakova-Georgantas
(74) *Attorney, Agent, or Firm* — Fish & Richardson P.C.

(57) ABSTRACT

Methods and compositions are provided for oligonucleotides that bind targets of interest. The targets include cells and microvesicles, such as those derived from various diseases. The oligonucleotides can be used for diagnostic and therapeutic purposes. The target of the oligonucleotides can be a therapeutic target such as Complement Component 1, Q Subcomponent (C1q) or a subunit thereof.

19 Claims, 73 Drawing Sheets
Specification includes a Sequence Listing.

(56) References Cited

U.S. PATENT DOCUMENTS

| | | |
|---|---|---|
| 5,317,098 A | 5/1994 | Shizuya |
| 5,371,241 A | 12/1994 | Brush |
| 5,376,252 A | 12/1994 | Ekstrom et al. |
| 5,391,723 A | 2/1995 | Priest |
| 5,414,077 A | 5/1995 | Lin |
| 5,416,203 A | 5/1995 | Letsinger |
| 5,451,463 A | 9/1995 | Nelson |
| 5,486,603 A | 1/1996 | Buhr |
| 5,510,475 A | 4/1996 | Agrawal |
| 5,512,439 A | 4/1996 | Hornes |
| 5,512,667 A | 4/1996 | Reed |
| 5,514,785 A | 5/1996 | Van Ness et al. |
| 5,525,465 A | 6/1996 | Haralambidis |
| 5,541,313 A | 7/1996 | Ruth |
| 5,545,730 A | 8/1996 | Urdea |
| 5,552,538 A | 9/1996 | Urdea |
| 5,565,552 A | 10/1996 | Magda et al. |
| 5,567,810 A | 10/1996 | Weis et al. |
| 5,574,142 A | 11/1996 | Meyer et al. |
| 5,578,717 A | 11/1996 | Urdea |
| 5,578,718 A | 11/1996 | Cook |
| 5,580,731 A | 12/1996 | Chang et al. |
| 5,580,737 A | 12/1996 | Polisky et al. |
| 5,585,481 A | 12/1996 | Arnold et al. |
| 5,587,371 A | 12/1996 | Sessler et al. |
| 5,591,584 A | 1/1997 | Chang et al. |
| 5,595,726 A | 1/1997 | Magda et al. |
| 5,597,696 A | 1/1997 | Linn et al. |
| 5,599,923 A | 2/1997 | Sessler et al. |
| 5,599,928 A | 2/1997 | Hemmi et al. |
| 5,608,046 A | 3/1997 | Cook |
| 5,637,459 A | 6/1997 | Burke et al. |
| 5,648,214 A | 7/1997 | Nieuwlandt et al. |
| 5,660,985 A | 8/1997 | Pieken et al. |
| 5,672,695 A | 9/1997 | Eckstein et al. |
| 5,683,867 A | 11/1997 | Biesecker et al. |
| 5,688,941 A | 11/1997 | Cook |
| 5,698,687 A | 12/1997 | Eckstein et al. |
| 5,736,330 A | 4/1998 | Fulton |
| 5,817,635 A | 10/1998 | Eckstein et al. |
| 5,958,691 A | 9/1999 | Pieken et al. |
| 6,011,020 A | 1/2000 | Gold et al. |
| 6,051,698 A | 4/2000 | Janjic et al. |
| 6,057,107 A | 5/2000 | Fulton |
| 6,329,209 B1 | 12/2001 | Wagner et al. |
| 6,365,418 B1 | 4/2002 | Wagner et al. |
| 6,406,921 B1 | 6/2002 | Wagner et al. |
| 6,408,878 B2 | 6/2002 | Unger et al. |
| 6,475,808 B1 | 11/2002 | Wagner et al. |
| 6,475,809 B1 | 11/2002 | Wagner et al. |
| 6,599,331 B2 | 7/2003 | Chandler et al. |
| 6,623,526 B1 | 9/2003 | Lloyd |
| 6,645,432 B1 | 11/2003 | Anderson et al. |
| 6,719,868 B1 | 4/2004 | Schueller et al. |
| 6,773,812 B2 | 8/2004 | Chandler |
| 6,793,753 B2 | 9/2004 | Unger et al. |
| 6,899,137 B2 | 5/2005 | Unger et al. |
| 6,929,030 B2 | 8/2005 | Unger et al. |
| 7,040,338 B2 | 5/2006 | Unger et al. |
| 7,118,661 B2 | 10/2006 | Surh et al. |
| 7,118,910 B2 | 10/2006 | Unger et al. |
| 7,125,711 B2 | 10/2006 | Pugia et al. |
| 7,135,147 B2 | 11/2006 | Cox |
| 7,138,062 B2 | 11/2006 | Yin et al. |
| 7,141,978 B2 | 11/2006 | Peck et al. |
| 7,144,616 B1 | 12/2006 | Unger et al. |
| 7,189,368 B2 | 3/2007 | Andersson et al. |
| 7,189,580 B2 | 3/2007 | Beebe |
| 7,189,581 B2 | 3/2007 | Beebe |
| 7,195,986 B1 | 3/2007 | Bousse et al. |
| 7,201,881 B2 | 4/2007 | Cox |
| 7,216,671 B2 | 5/2007 | Unger et al. |
| 7,229,538 B2 | 6/2007 | Tseng et al. |
| 7,233,865 B2 | 6/2007 | Chien |
| 7,238,255 B2 | 7/2007 | Derand et al. |
| 7,238,324 B2 | 7/2007 | Ko et al. |
| 7,250,128 B2 | 7/2007 | Unger et al. |
| 7,253,003 B2 | 8/2007 | Beebe |
| 7,258,837 B2 | 8/2007 | Yager |
| 7,261,824 B2 | 8/2007 | Schlautmann et al. |
| 7,274,316 B2 | 9/2007 | Moore |
| 7,323,140 B2 | 1/2008 | Handique |
| 7,329,391 B2 | 2/2008 | Cox |
| 7,338,637 B2 | 3/2008 | Pease et al. |
| 7,351,380 B2 | 4/2008 | Simmons et al. |
| 7,351,592 B2 | 4/2008 | Storek et al. |
| 7,357,864 B2 | 4/2008 | Takada et al. |
| 7,381,471 B2 | 6/2008 | Augustine et al. |
| 7,390,463 B2 | 6/2008 | He et al. |
| 7,399,600 B2 | 7/2008 | Carr |
| 7,399,632 B2 | 7/2008 | Simmons |
| 7,402,229 B2 | 7/2008 | Sibbett |
| 7,411,184 B2 | 8/2008 | Sarrut |
| 7,413,709 B2 | 8/2008 | Roitman et al. |
| 7,419,639 B2 | 9/2008 | Osterfeld |
| 7,419,822 B2 | 9/2008 | Jeon et al. |
| 7,422,669 B2 | 9/2008 | Jacobson |
| 7,422,725 B2 | 9/2008 | Kimizuka |
| 7,431,887 B2 | 10/2008 | Storek et al. |
| 7,445,844 B2 | 11/2008 | Chandler et al. |
| 7,449,096 B2 | 11/2008 | Berndt et al. |
| 7,452,509 B2 | 11/2008 | Cox |
| 7,452,713 B2 | 11/2008 | Barlocchi et al. |
| 7,467,928 B2 | 12/2008 | Fakunle et al. |
| 7,485,214 B2 | 2/2009 | Palmieri |
| 7,488,596 B2 | 2/2009 | Lee et al. |
| 7,494,555 B2 | 2/2009 | Unger et al. |
| 7,501,245 B2 | 3/2009 | Quake |
| 7,518,726 B2 | 4/2009 | Rulison et al. |
| 7,541,578 B2 | 6/2009 | Weng |
| 7,544,506 B2 | 6/2009 | Breidford et al. |
| 7,552,741 B2 | 6/2009 | Yamada et al. |
| 7,568,399 B2 | 8/2009 | Sparks |
| 7,575,722 B2 | 8/2009 | Arnold |
| 7,579,136 B2 | 8/2009 | Shim et al. |
| 7,581,429 B2 | 9/2009 | Sparks et al. |
| 7,591,936 B2 | 9/2009 | Sarrut |
| 7,601,270 B1 | 10/2009 | Unger et al. |
| 7,640,947 B2 | 1/2010 | Fernandes et al. |
| 7,666,361 B2 | 2/2010 | McBride et al. |
| 7,691,333 B2 | 4/2010 | McBride et al. |
| 7,704,735 B2 | 4/2010 | Facer et al. |
| 7,751,053 B2 | 7/2010 | Carr |
| 7,754,010 B2 | 7/2010 | Unger et al. |
| 7,837,946 B2 | 11/2010 | McBride et al. |
| 7,955,802 B2 | 6/2011 | Whitman |
| 8,008,019 B2 | 8/2011 | Merante et al. |
| 8,124,015 B2 | 2/2012 | Diercks et al. |
| 2003/0061687 A1 | 4/2003 | Hansen et al. |
| 2003/0064402 A1 | 4/2003 | Egholm et al. |
| 2003/0078221 A1 | 4/2003 | Biesecker et al. |
| 2003/0186277 A1 | 10/2003 | Olek et al. |
| 2005/0084421 A1 | 4/2005 | Unger et al. |
| 2005/0112882 A1 | 5/2005 | Unger et al. |
| 2005/0129581 A1 | 6/2005 | McBride et al. |
| 2005/0145496 A1 | 7/2005 | Goodsaid et al. |
| 2005/0201901 A1 | 9/2005 | Grossman et al. |
| 2005/0214173 A1 | 9/2005 | Facer et al. |
| 2005/0252773 A1 | 11/2005 | McBride et al. |
| 2006/0006067 A1 | 1/2006 | Unger |
| 2012/0028242 A1 | 2/2012 | Heyduk et al. |
| 2012/0258870 A1 | 10/2012 | Schwartz et al. |
| 2013/0017837 A1 | 1/2013 | Hakola et al. |
| 2014/0371088 A1 | 12/2014 | Webster |

FOREIGN PATENT DOCUMENTS

| | | | |
|---|---|---|---|
| WO | WO 1993/022684 | 11/1993 | |
| WO | WO 98/18480 | 5/1998 | |
| WO | WO 92/07065 | 8/1999 | |
| WO | WO 99/41271 | 8/1999 | |
| WO | WO-0179232 A2 * | 10/2001 | ........... C12Q 1/6886 |
| WO | WO 2007/103572 | 9/2007 | |
| WO | WO 2007/137187 | 11/2007 | |

(56) References Cited

FOREIGN PATENT DOCUMENTS

| WO | WO 2009/015357 | 1/2009 |
|---|---|---|
| WO | WO 2009/036236 | 3/2009 |
| WO | WO 2012/024543 | 2/2010 |
| WO | WO 2010/045318 | 4/2010 |
| WO | WO 2010/056337 | 5/2010 |
| WO | WO 2010/062706 | 6/2010 |
| WO | WO 2010/065765 | 6/2010 |
| WO | WO 2010/072410 | 7/2010 |
| WO | WO 2010/093465 | 8/2010 |
| WO | WO 2010/141862 | 12/2010 |
| WO | WO 2011/056688 | 5/2011 |
| WO | WO 2011/066589 | 6/2011 |
| WO | WO 2011/088226 | 7/2011 |
| WO | WO 2011/109440 | 9/2011 |
| WO | WO 2011/127219 | 10/2011 |
| WO | WO 2012/092336 | 7/2012 |
| WO | WO 2012/170711 | 12/2012 |
| WO | WO 2012/170715 | 12/2012 |
| WO | WO 2012/174282 | 12/2012 |
| WO | WO 2013/020995 | 2/2013 |
| WO | WO 2013/022786 | 2/2013 |
| WO | WO 2013/022995 | 2/2013 |
| WO | WO 2013/134786 | 9/2013 |
| WO | WO 2014/068408 | 5/2014 |
| WO | WO 2014/082083 | 5/2014 |
| WO | WO 2014/089241 | 6/2014 |
| WO | WO 2014/100434 | 6/2014 |
| WO | WO 2014/190214 | 11/2014 |
| WO | WO 2014/193999 | 12/2014 |
| WO | WO 2015/116868 | 8/2015 |
| WO | WO 2016/081941 | 5/2016 |
| WO | WO 2016/141169 | 9/2016 |
| WO | WO 2016/145128 | 9/2016 |

OTHER PUBLICATIONS

Cerchia & de Franciscis, "Nucleic Acid Aptamers Against Protein Kinases" Current Medicinal Chemistry, 2011, 18(27):4152-4158.
Charras et al., "Blebs lead the way: how to migrate without lamellipodia," Nature Reviews Molecular and Cell Biology, Jul. 2008, 9(11):730-736.
Chen et al., "Microfluidic isolation and transcriptome analysis of serum vesicles," Lab on a Chip, 2010, 10:505-511.
Chromy et al., "Proteomic Analysis of Human Serum by Two Dimensional Differential Gel Electrophoresis after Depletion of High-Abundant Proteins," J. Proteome Res., 2004, 3:1120-1127.
Colcher et al.,"Effects of genetic engineering on the pharmacokinetics of antibodies," Q. J. Nucl. Med., 1999, 43:132-139.
Cotten et al, "2'-O-methyl, 2'-O-ethyl oligodeoxyribonucleotides as inhibitors oligoribonucleotides and phosphorothioate of the in vitro U7 snRNP-dependent mRNA processing event," Nucl. Acid Res., May 1991, 19:2629-2635.
Crooke et al., "Pharmacokinetic properties of several novel oligonucleotide analogs in mice," J. Pharmacol. Exp., Ther., 1996, 277(2):923-937.
Cutillas et al., "Proteomic analysis of plasma membrane vesicles isolated from the rat renal cortex," Proteomics, Jan. 2005, 5:101-112.
Cutillas et al., "Quantification of Gel-separated Proteins and Their Phosphorylation Sites by LC-MS Using Unlabeled Internal Standards," Mol. Cell. Proteomics, 2005, 4:1038-1051.
Espelund et al., "A simple method for generating single-stranded DNA probes labeled to high activities," Nucleic Acids Res., 1990, 18(20):6157-6158.
European Supplementary European Search Report in European Appln. No. 16818715, dated Feb. 28, 2019, 11 pages.
Fan et al., "Illumina universal bead arrays," Methods Enzymol., 2006 410:57-73.
Froehler et al., "Deoxynucleoside H-Phosphonate diester intermediates in the synthesis of internucleotide phosphate analogues," Tet. Lett., 1986, 27:5575-5578.

Froehler et al., "Synthesis of DNA via deoxynudeoside H-phosphonate Intermediates," Nucl. Acid Res., Jul. 1986, 14:5399-5467.
Garlatti et al., Cutting edge: C1q binds deoxyribose and heparan sulfate through neighboring sites of its recognition domain, J Immunol 185 (2010) 808-812.
Ghebrehiwet et al., "The C1q Family of Proteins: Insights into the Emerging Non-Traditional Functions," Front Immunol., 2012, 3:52, 9 pages.
Gyllensten & Erlich, "Generation of single-stranded DNA by the polymerase chain reaction and its application to direct sequencing of the HLA-DQA locus," Proc. Natl. Acad. Sci. USA, 1988, 85:7652-7656.
Hahner et al., "Matrix-assisted laser desorption/ionization mass spectrometry of DNA using photocleavable biotin," Biomol Eng. 1999, 16:127-133.
Hamedani et al., "Selection of high affinity DNA-aptamer for activated protein C using capillary electrophoresis," Research in Pharmaceutical Sciences, 2012, 7(5):S987, 1 page.
Hicke & Stephens, "Escort aptamers: a delivery service for diagnosis and therapy", J. Clin. Invest., 2000, 106:923-928.
Higuchi & Ochman, "Production of single-stranded DNA templates by exonuclease digestion following the polymerase chain reaction," Nucleic Acids Res., 1989, 17(14)5865.
Hirose et al., "Rapid synthesis of trideoxyribonucleotide blocks," Tet. Lett., 1989, 28:2449-2452.
Hobbs, et al., "Polynucleotides containing 2'-amino-2'-deoxyribose and 2'-azido-2'-deoxyribose," Biochemistry, Dec. 1973, 12:5138-5145.
International Preliminary Report on Patentability in International Application No. PCT/US2016/40157, dated Jan. 2, 2018, 10 pages.
International Search Report and Written Opinion in International Application No. PCT/US2016/40157, dated Nov. 28, 2016, 16 pages.
Jiang et al., "DNA binds and activates complement via residues 14-26 of the human C1q A chain," J. Biol. Chem., 1992, 267(35):25597-25601.
Jones et al., "High-affinity aptamers to subtype 3a hepatitis C virus polymerase display genotypic specificity," Antimicrob. Agents Chemother., 2006, 50:3019-3027.
Kabanov et al., "A new class of antivirals: antisense oligonucleotides combined with a hydrophobic substituent effectively inhibit influenza virus reproduction and synthesis of virus-specific proteins in MDCK cells," Febs Lett., Jan. 1990, 259(2):327-330.
Kartalov et al., "High-throughput multi-antigen microfluidic fluorescence immunoassays," Biotechniques, Jan. 2006, 40(1):85-90.
Kaur & Yung, "Probing High Affinity Sequences of DNA Aptamer against VEGF165," PLoS One, Feb. 2012, 7(2):e31196, 9 pages.
Keller et al., "Exosomes: from biogenesis and secretion to biological function," Immunol. Lett., Oct. 2006, 107(2):102-108.
Kishore et al, "C1q and tumor necrosis factor superfamily: modularity and versatility," Trends in Immunology, Oct. 2004, 25(10):551-561.
Kouser et al., "Emerging and Novel Functions of Complement Protein C1q," Front Immunol., Jun. 2015, 6:317, 19 pages.
Krieger et al., "Characterization of immune complexes detected by the 125I-C1q binding assay in breast cancer," Clin. Immunol. Immunopathol., 1988, 46:14-23.
Kuypers et al., "On-line melting of double-stranded DNA for analysis of single-stranded DNA using capillary electrophoresis," J. Chromatogr. B Biomed. Appl., 1996, 675:205-211.
Letsinger et al.,"Cholesteryl-conjugated oligonucleotides: synthesis, properties, and activity as inhibitors of replication of human immunodeficiency virus in cell culture," Proc. Natl. Acad. Sci. USA, 1989, 86:6553-6556.
Li et al., "The Oral Fluid MEMS/NEMS Chip (OFMNC): Diagnostic & Translational Applications," Adv. Dent. Res., Jun. 2005, 18(1): 3-5.
Manoharan et al., "Chemical Modifications to Improve Uptake and Bioavailability of Antisense Oligonucleotides," Ann. N. Y. Acad. Sci., Oct. 1992, 660, 306-309.
Manoharan et al., "Cholic acid-oligonucleotide conjugates for antisense applications," Bioorg. Med. Chem., 1994, 4:1053-1060.

(56) References Cited

OTHER PUBLICATIONS

Manoharan et al., "Introduction of a Lipophilic Thioether Tether in the Minor Groove of Nucleic Acids for Antisesnse Applications," Bioorg. Med. Chem. Let. 1993, 3(12):2765-2770.
Manoharan et al., "Oligonucleotide Conjugates: Alteration of the Pharmacokinetic Properties of Antisense Agents," Nucleosides & Nucleotides, 1995, 14(3-5):969-973.
Manoharan et al.,"Lipidic nucleic acids," Tetrahedron Lett., 1995, 36(21):3651-3654.
Mere et al., "Miniaturized Fret assays and microfluidics: key components for ultra-high-throughput screening," Drug Discovery Today, 1999, 4(8):363-369.
Mishra et al., "Improved leishmanicidal effect of phosphorotioate antisense oligonucleotides by LDL-mediated delivery," Biochim. Biophys. Acta., 1995, 1264:229-237.
Mitkevich et al., "DNA aptamers detecting generic amyloid epitopes," Prion, 2012, 6(4):400-406.
Navratil et al., "The globular heads of C1q specifically recognize surface blebs of apoptotic vascular endothelial cells," J. Immunol., 2001, 166(5):231-3239.
Nayak et al., "Complement and non-complement activating functions of C1q: a prototypical innate immune molecule," Innate Immun., Apr. 2012, 18(2):350-363.
Nida et al., "Fluorescent nanocrystals for use in early cervical cancer detection," Gynecologic Oncology, 2005, 99(3):S89-S94.
Oberhauser et al., "Effective incorporation of 2'-O-methyl-oligoribonucleotides into liposomes and enhanced cell association through modification with thiocholesterol," Nucl. Acids Res., 1992, 20:533-538.
Oh et al., "Rapid, Efficient Aptamer Generation: Kinetic-Challenge Microfluidic SELEX," presented in the 12th Annual UC Systemwide Bioengineering Symposium, Jun. 13-15, 2011, Santa Barbara, USA.
Olejnik et al., "Photocleavable Affinity Tags for Isolation and Detection of Biomolecules," Methods Enzymol., 1998, 291:135-154.
Olejnik et al., "Photocleavable Biotin Derivatives: a Versatile Approach for the Isolation of Biomolecules," Proc. Natl. Acad. Sci. USA, Aug. 1995, 92(16):7590-7594.
Olejnik et al., "Photocleavable biotin phosphoramidite for 5'-end-labeling, affinity purification and phosphorylation of synthetic oligonucleotides," Nucleic Acids Res., Jan. 1996, 24(2):361-366.
Païdassi et al., "The lectin-like activity of human C1q and its implication in DNA and apoptotic cell recognition," FEBS Letters, 2008, 582:3111-3116.
Paul et al., "Streptavidin-coated magnetic beads for DNA strand separation implicate a multitude of problems during cell-SELEX," Oligonucleotides 2009, 19(3):243-254.
Pei et al., "Clinical applications of nucleic acid aptamers in cancer (Review), Mol. Clin. Oncol., May 2014, (3):341-348.
Pflieger et al., "Analysis of Human C1q by Combined Bottom-up and Top-down Mass Spectrometry," Mol Cell Proteomics, Apr. 2010, 9(4):593-610.
Pipper et al., "Clockwork PCR Including Sample Preparation," Angewandte Chemie, 2008, 47(21):3900-3904.
Pisitkun et al., "Identification and proteomic profiling of exosomes in human urine," Proc. Natl. Acad. Sci., USA, 2004, 101:13368-13373.
Reff and Heard, "A review of modifications to recombinant antibodies: attempt to increase efficacy in oncology applications," Critical Reviews in Oncology/Hematology, 2001, 40:25-35.
Shea et al., "Synthesis, hybridization properties and antiviral activity of lipid-oligodeoxynucleotide conjugates," Nucl. Acids Res., 1990, 18(13):3777-3783.
Son et al., "Fundamental role of C1q in autoimmunity and inflammation," Immunol Res., 2015, 63(1-3):101-106.
Sood & Narang, "A rapid and convenient synthesis of polythymidylic acid by the modified triester approach," Nucl. Acid Res., Aug. 1977, 4:2557-2765.
Sproat et al., "New synthetic routes to synthons suitable for 2'-O-allyloligoribonucleotide assembly," Nucl. Acid Res., Feb. 1991, 19:733-738.
Srinivas et al., "Aptamer-functionalized microgel particles for protein detection," Anal. Chem. Oct. 2011, 83:9138-9145.
Srinivas et al., "Aptamer-Functionalized Microgel Particles for Protein Detection," Anal. Chem., Oct. 2011, 83(23):9138-9145.
Svinarchuk et al., "Inhibition of HIV proliferation in MT-4 cells by antisense oligonucleotide conjugated to lipophilic groups," Biochimie, Jan. 1993, 75:49-54.
Svobodova et al., "Comparison of different methods for generation of single-stranded DNA for SELEX processes," Anal. Bioanal. Chem., 2012, 404:835-842.
Tang et al., "Chip-based genotyping by mass spectrometry," Proc. Natl. Acad. Sci., USA, Aug. 1999, 96(18):10016-10020.
Tucker et al., "Detection and plasma pharmacokinetics of an anti-vascular endothelial growth factor oligonucleotide-aptamer (NX1838) in rhesus monkeys," J. Chromatography B., Sep. 1999, 732:203-212.
Unger et al., "Single-Molecule Fluorescence Observed with Mercury Lamp Illumination," Biotechniques, Nov. 1999, 27(5):1008-1014.
Williams & Bartel, "PCR product with strands of unequal length," Nucleic Acids Research, 1995, 23(20):4220-4221.
Wu & Curran, "An Allosteric Synthetic DNA," Nucleic Acids Res. 1999, 27(6):1512-1516.
Wu et al., "Identification, Characterization and Application of a G-Quadruplex Structured DNA Aptamer against Cancer Biomarker Protein Anterior Gradient Homolog 2," PloS One, Sep. 2012, 7(9):e46393, 9 pages.
Zhang et al., "High Throughput Quantitative Analysis of Serum Proteins Using Glycopeptide Capture and Liquid Chromatography Mass Spectrometry," Mol Cell Proteomics, 2005, 4:144-155.
Zhang et al "Indirect purification method provides high yield and quality ssDNA sublibrary for potential aptamer selection," Anal. Biochem. 2015, 27 pages.
Zhou and Rossi, "Cell-type-specific, Aptamer-functionalized Agents for Targeted Disease Therapy," Mol. Ther. Nucleic Acids, Jun. 2014, 3:e169, 17 pages.
European Extended European Search Report in European Appln. No. 16818715, dated Jun. 3, 2019, 11 pages.

\* cited by examiner

Screening Scheme

| 5 | x | 20 | = | 100 |
|---|---|---|---|---|
| Detection Antibodies | | Capture Antibodies | | Combinations Screened |

| Detection | Capture |
|---|---|
| CD63 | CD9, Rab |
| CD9 | PSCA, IgG |
| CD81 | TNFR, CD81 |
| B7H3 | CD63 2X, STEAP |
| EpCam | B7H3, PCSA |
| | Rab IgG, PSMA |
| | MFG-E8, 5T4 |
| | EpCam 2X, CD24 |
| | CD63, TMEM211 |

General vesicle biomarker antibodies: CD9, CD63, CD81
Cell of Origin biomarker antibodies: PSCA, MFG-E8, Rab, STEAP, PCSA, PSMA, 5T4, TMEM211
Cancer biomarker antibodies: EpCam, B7H3, CD24
Control antibodies: Rab IgG, IgG

FIG. 2C

SEQ ID NO. 1

SEQ ID NO. 2

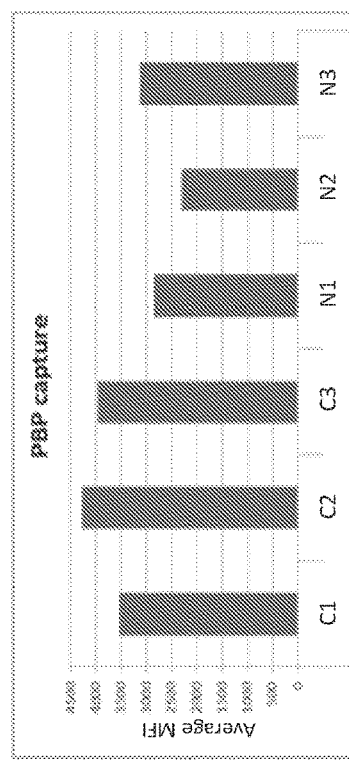
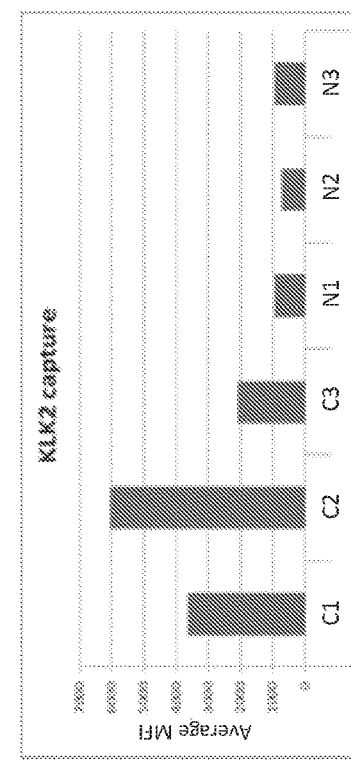
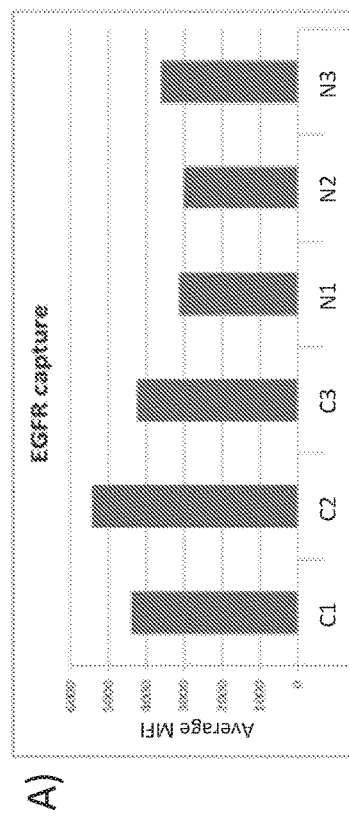
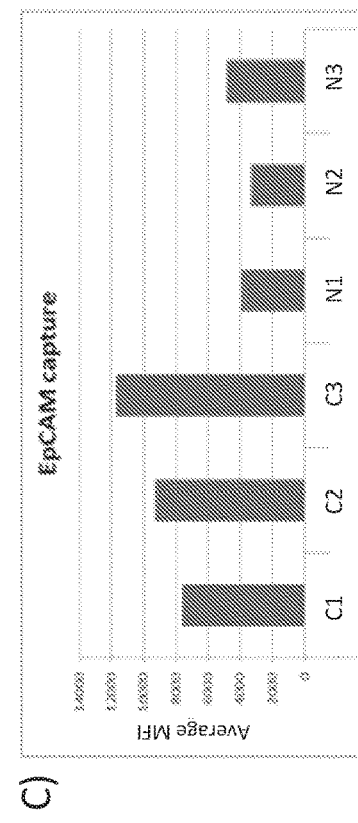
FIG. 6

A) SEQ ID NO. 4
5'-ATCCAGAGTGACGCAGCAGTCTTTTCTGATGGACACGTGGTGGTCTAGTATCTGGACACGGTGGCTTAGT
B) SEQ ID NO. 5
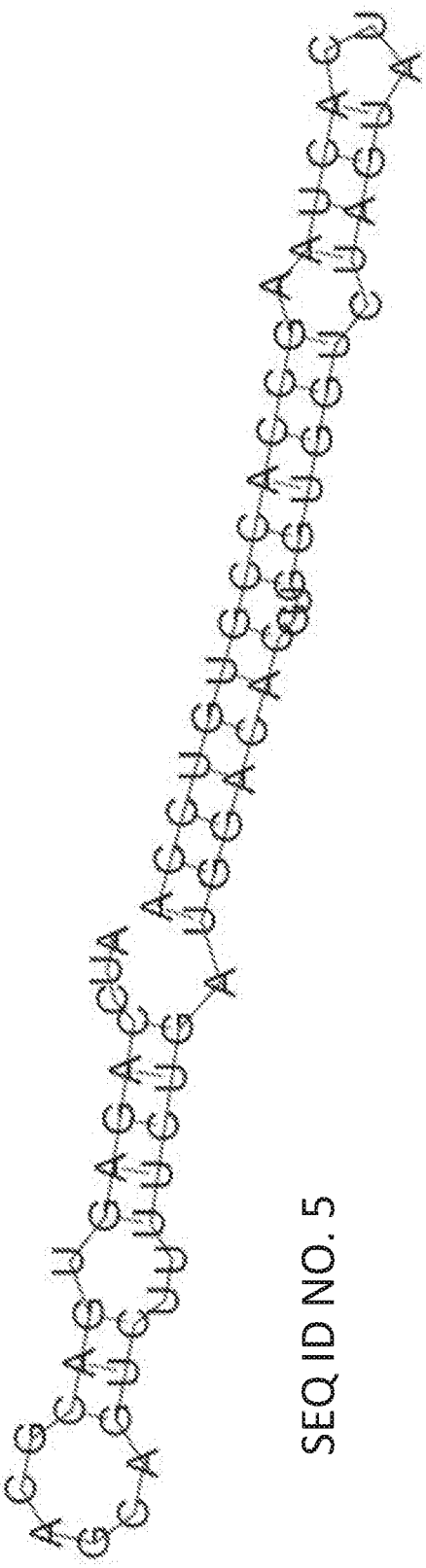
FIGs. 7A-B

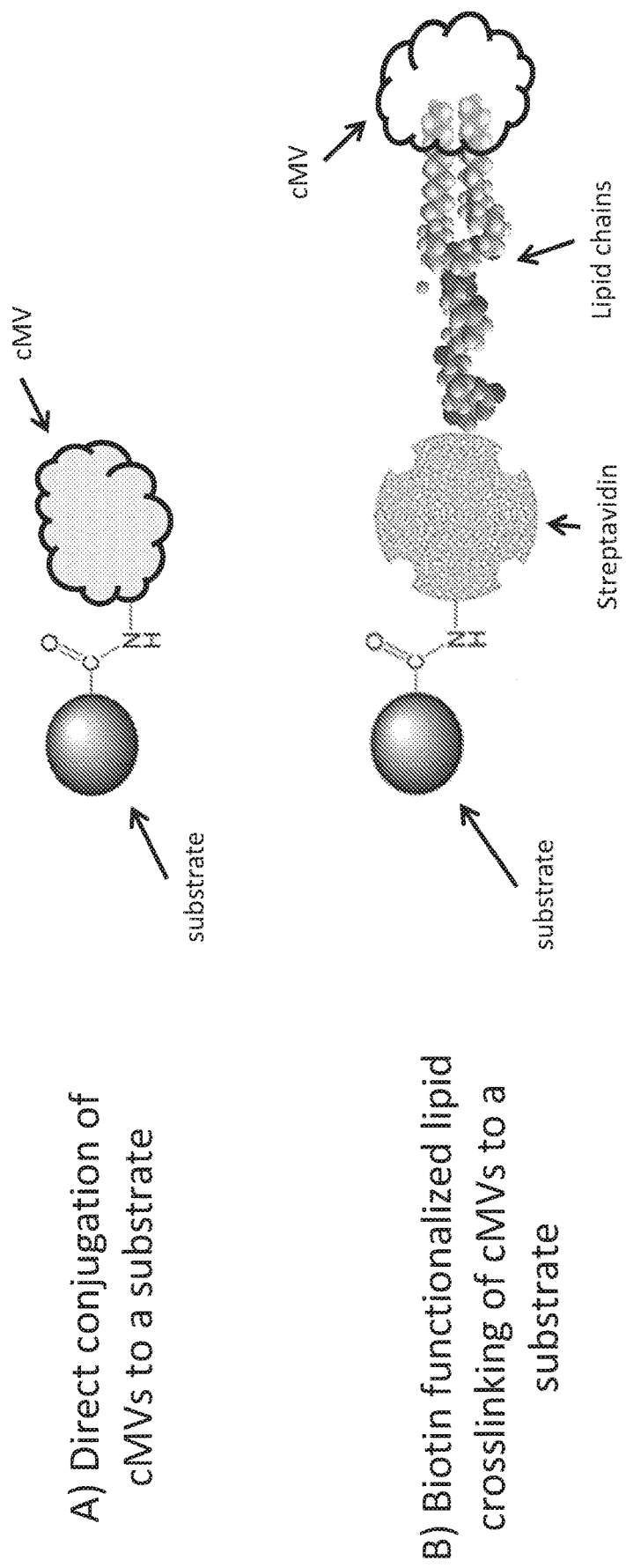
FIGs. 8A-B

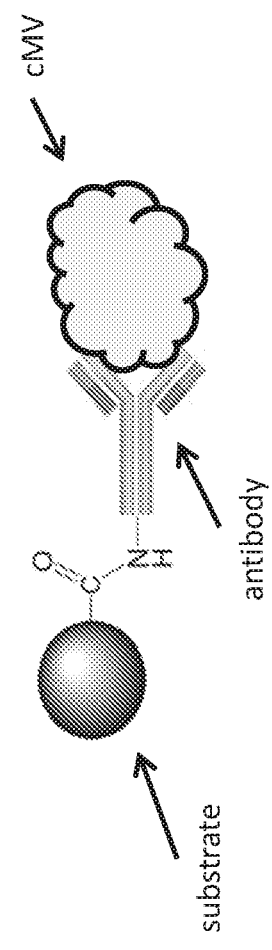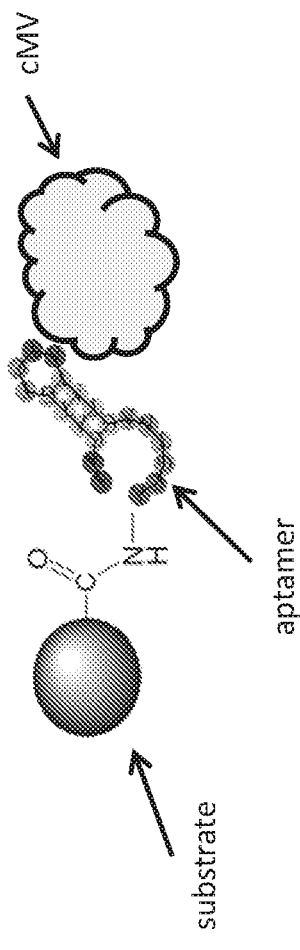
C) Immuno-precipitation of cMVs with cMV specific antibodies immobilized to a substrate
D) Immuno-precipitation of cMVs with cMV specific aptamer immobilized to a substrate
FIGs. 8C-D

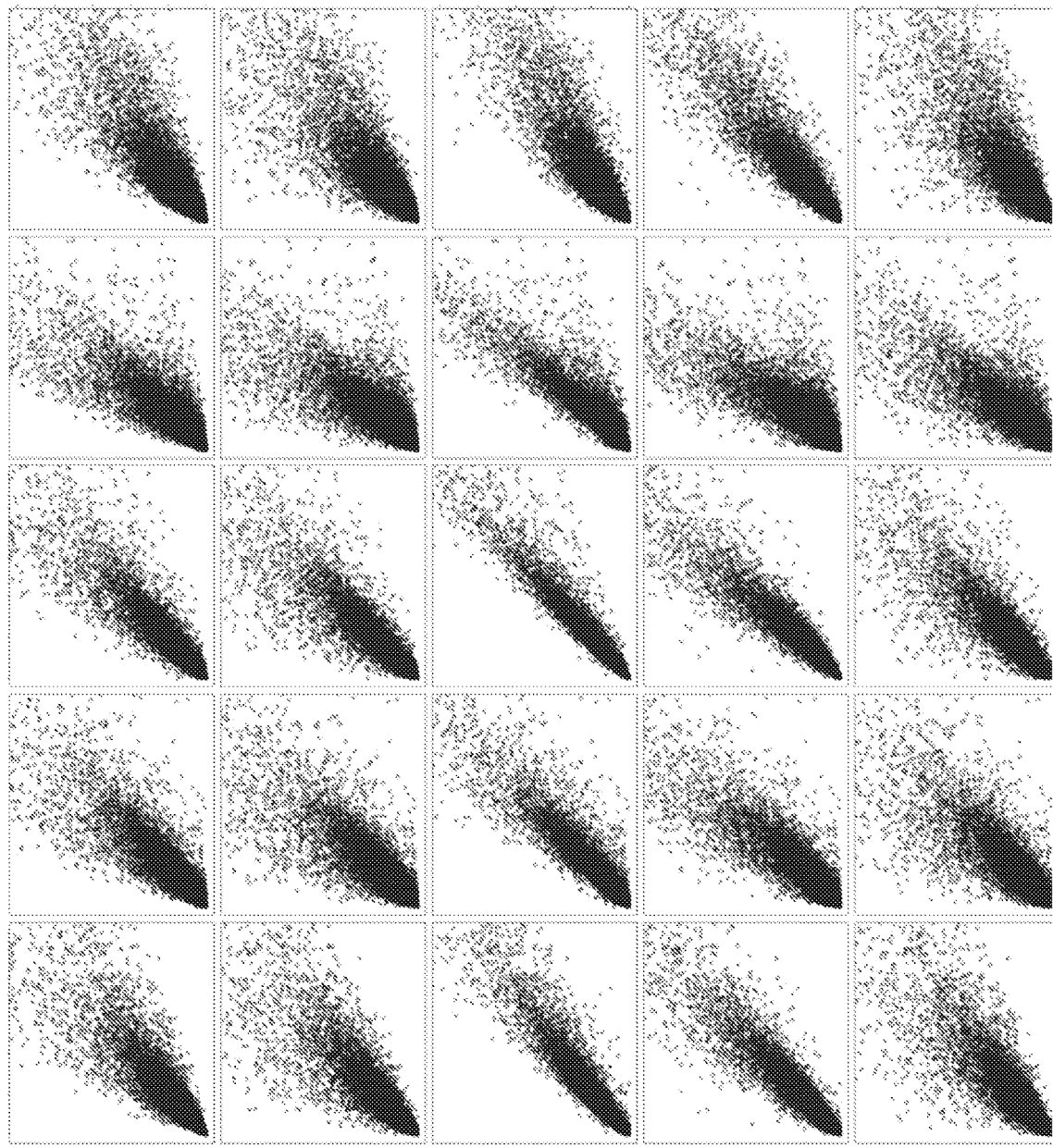

Cancer v Non-Cancer

| | P-0.005 |
|---|---|
| d-50 | 2471 |
| d-100 | 1615 |
| d-200 | 914 |
| d-500 | 315 |

| | P-0.005 |
|---|---|
| d-50 | 2.95% |
| d-100 | 3.07% |
| d-200 | 3.18% |
| d-500 | 3.10% |
| Random | 0.50% |

Random

| | P-0.005 |
|---|---|
| d-50 | 49 |
| d-100 | 27 |
| d-200 | 17 |
| d-500 | 5 |

| | P-0.005 |
|---|---|
| d-50 | 0.06% |
| d-100 | 0.05% |
| d-200 | 0.06% |
| d-500 | 0.05% |
| Random | 0.50% |

FIG. 12E

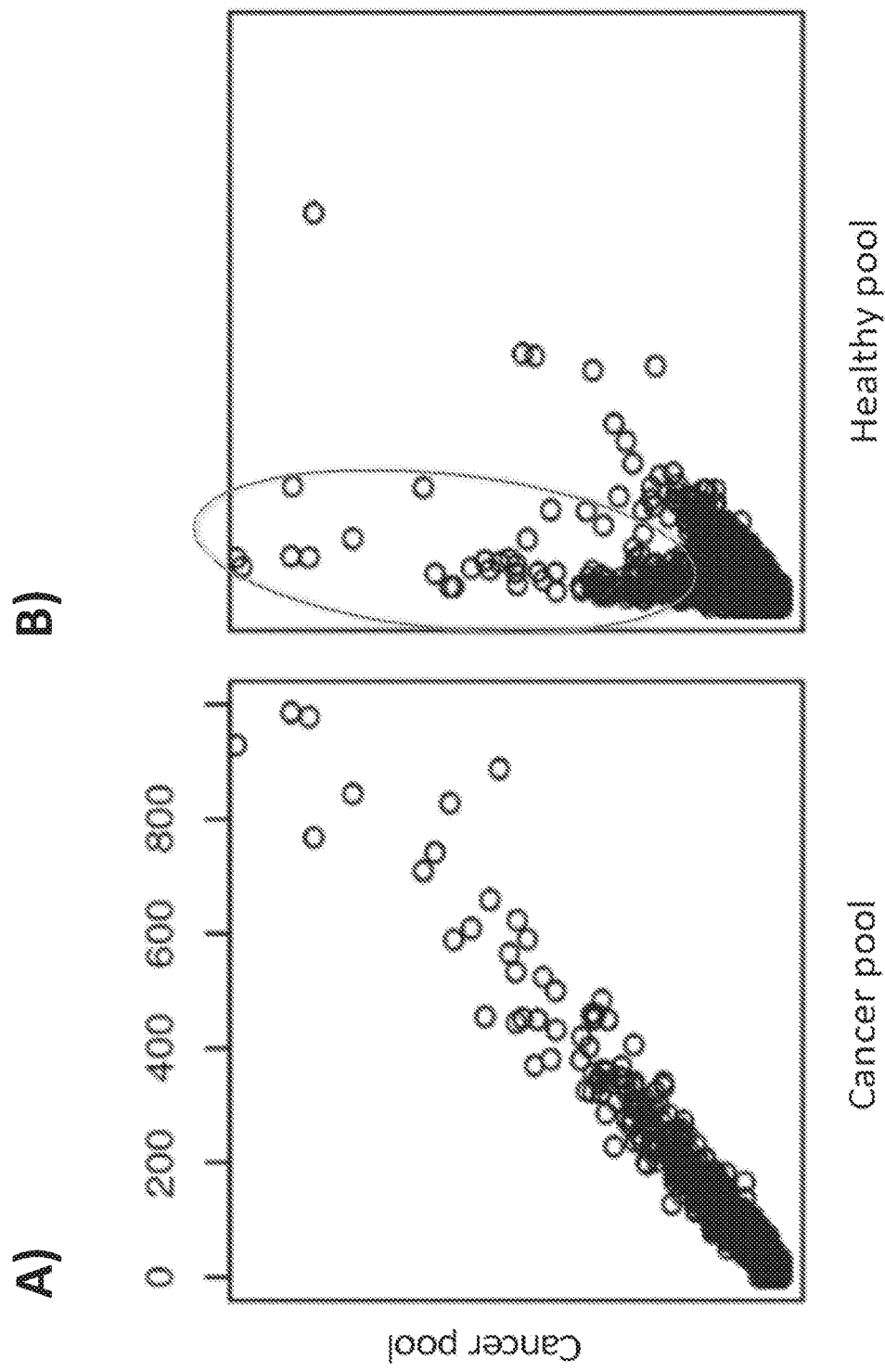
FIGS. 14A-B

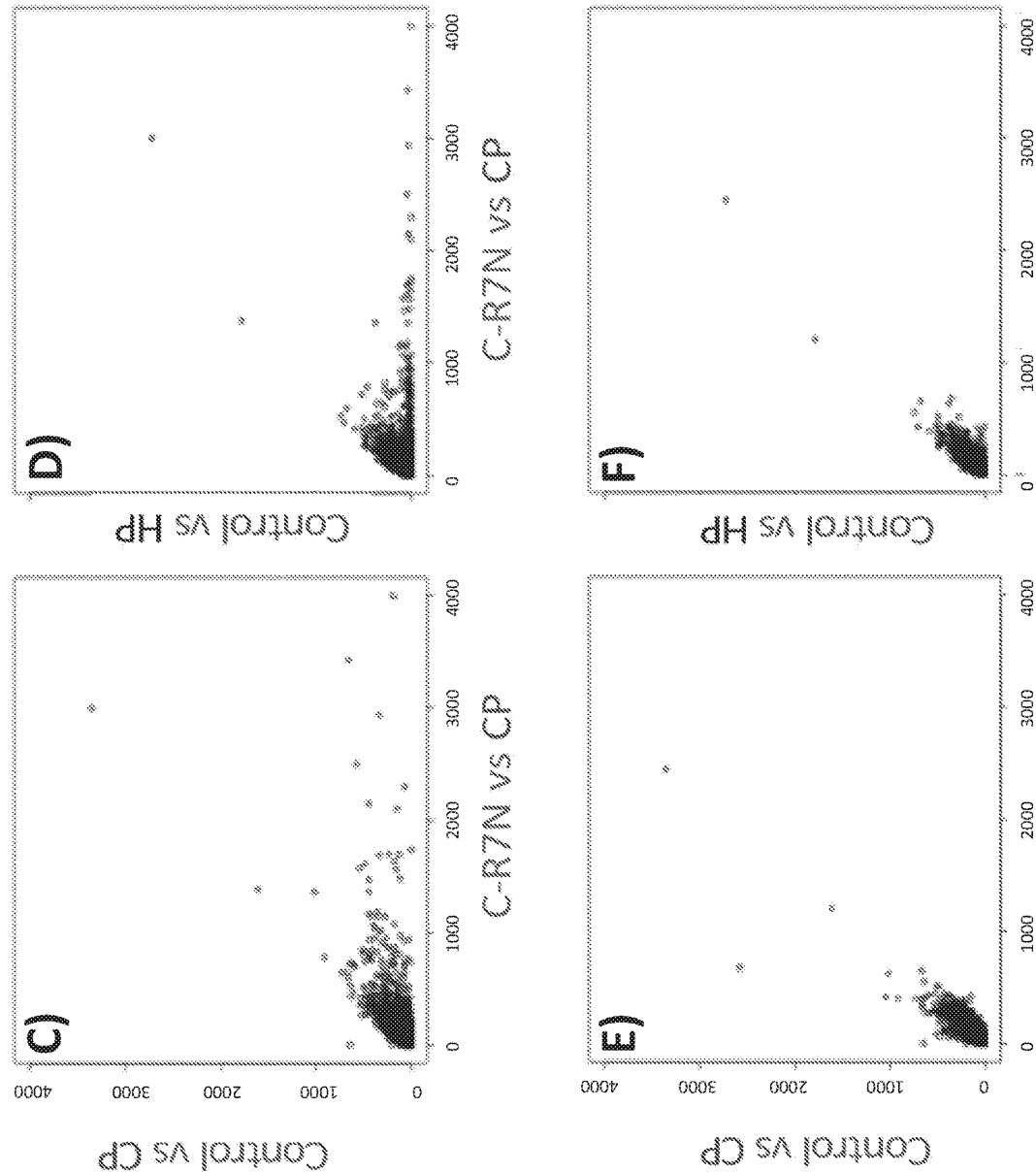
FIGs. 14C-F

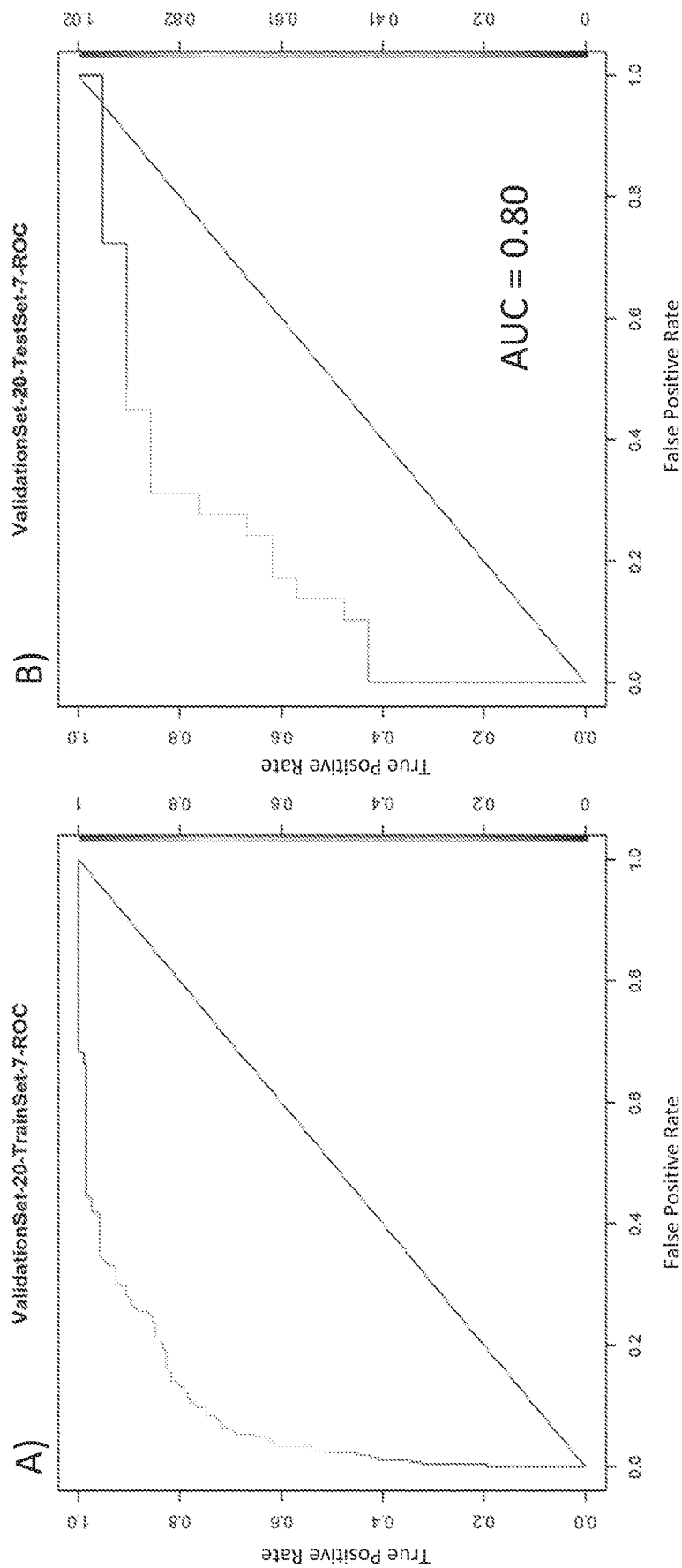
FIG. 16A-B

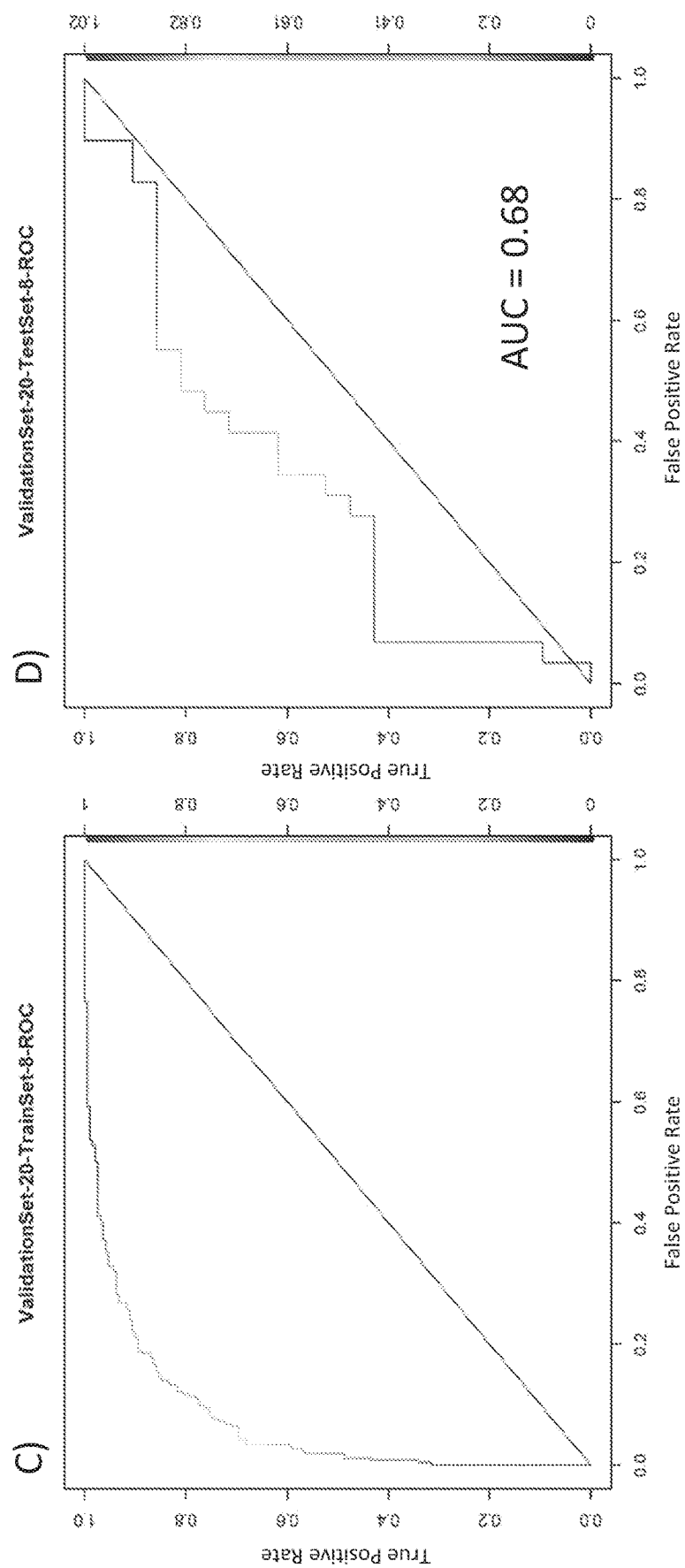
FIG. 16C-D

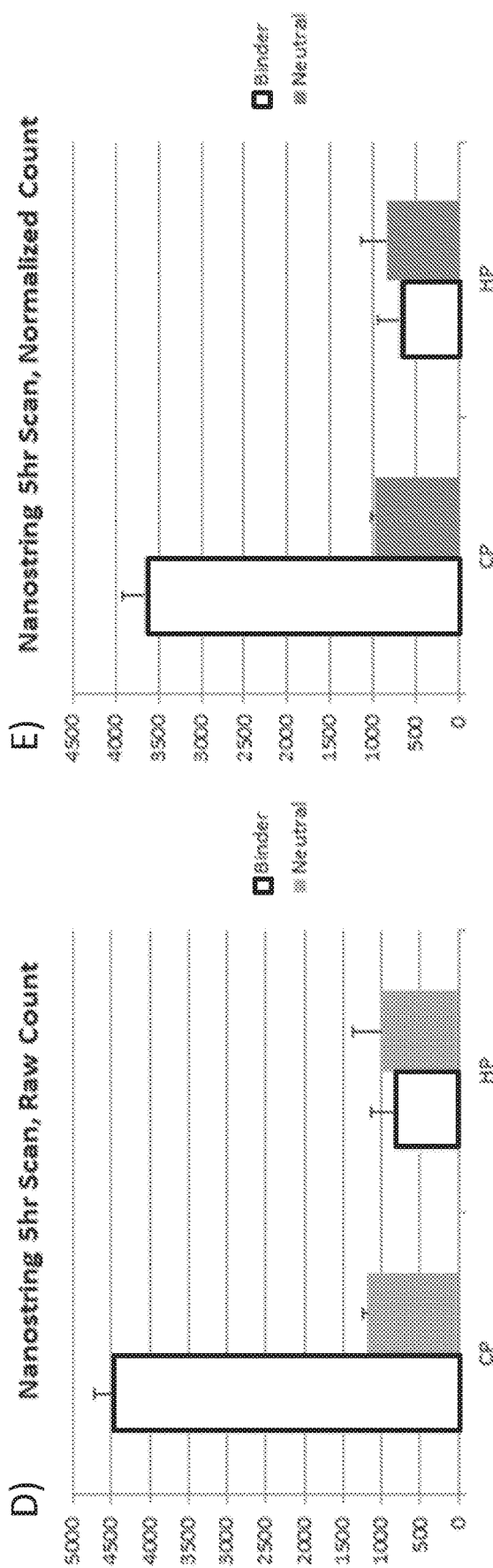
FIGs. 17D-E

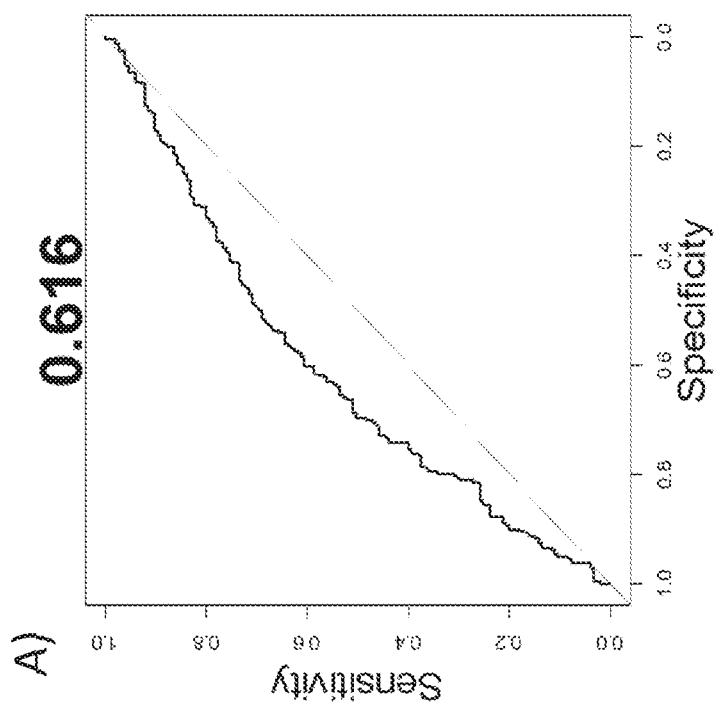
FIGS. 22A-B

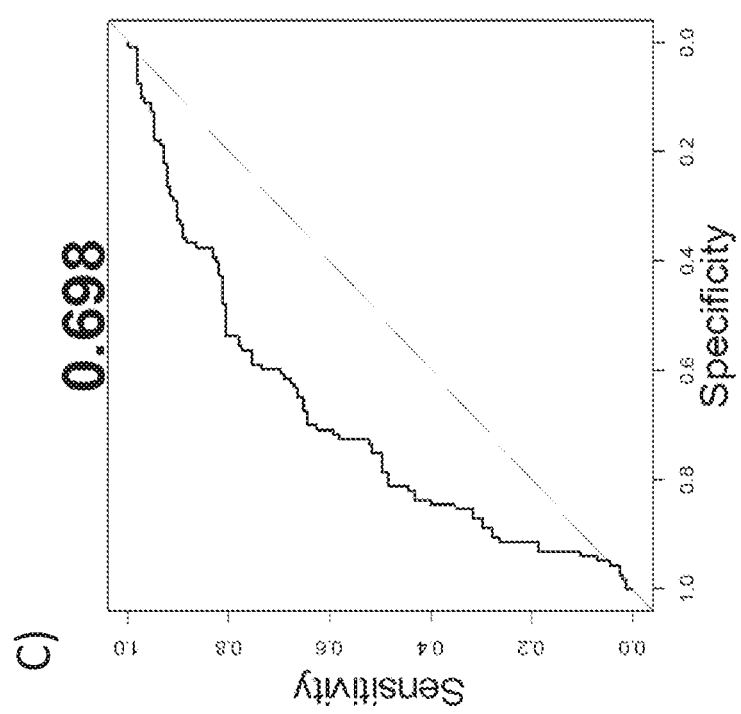
FIGs. 22C-D

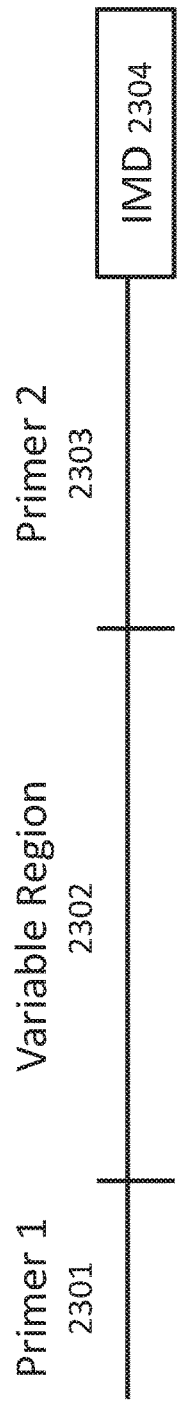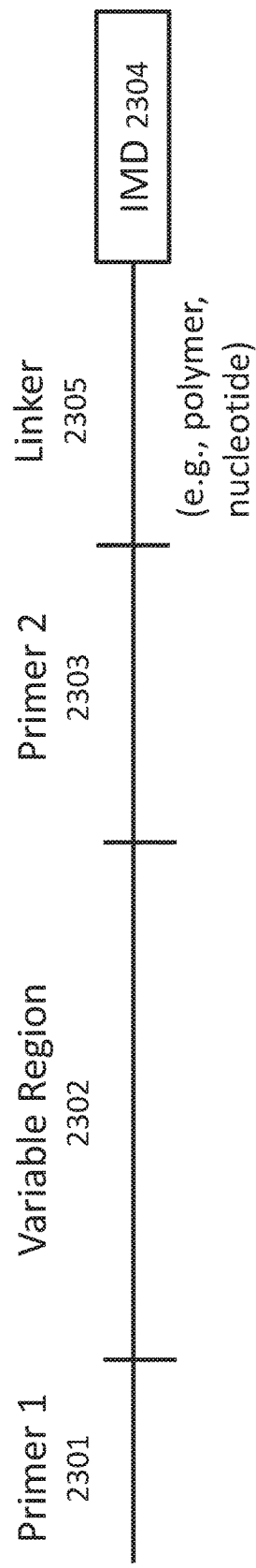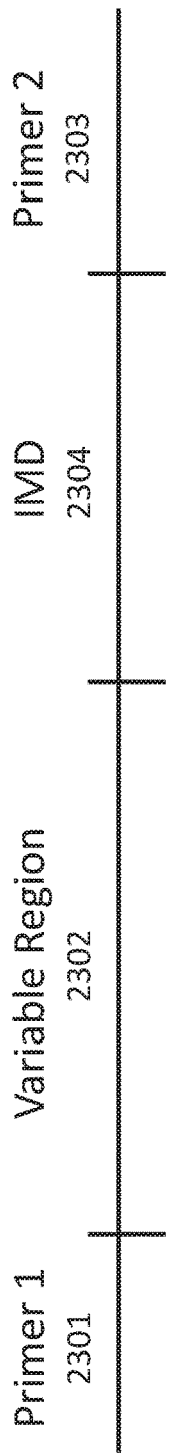
FIG. 23A

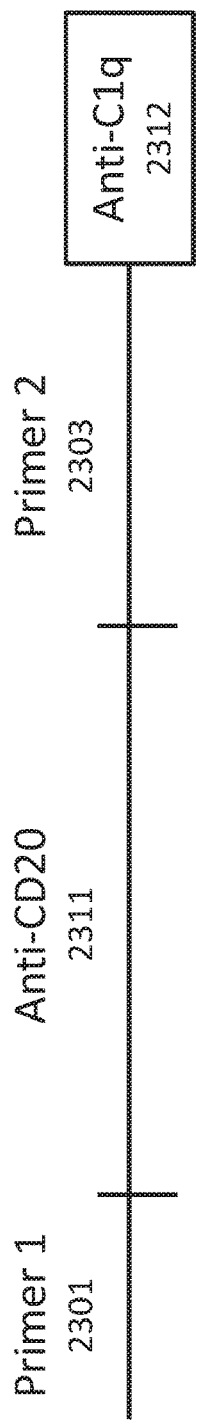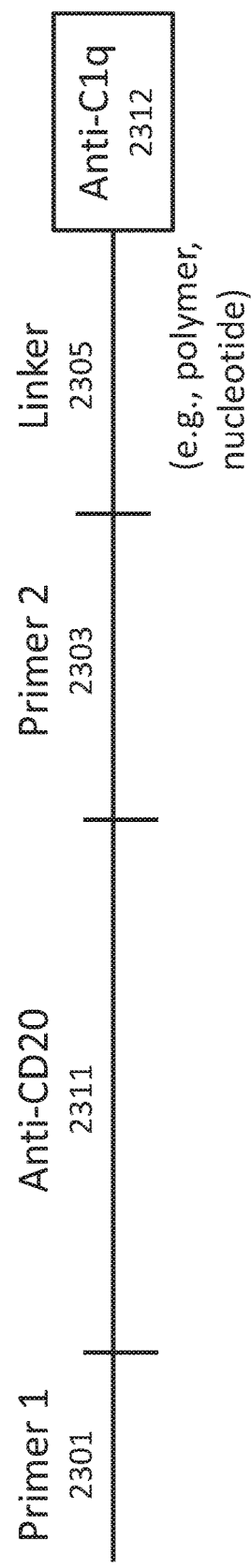
FIG. 23B

THERAPEUTIC OLIGONUCLEOTIDES

CROSS REFERENCE

This application claims the benefit of U.S. Provisional Patent Application Nos. 62/186,242, filed Jun. 29, 2015; 62/198,110, filed Jul. 28, 2015; 62/220,652, filed Sep. 18, 2015; 62/239,226, filed Oct. 8, 2015; 62/269,671, filed Dec. 18, 2015; and 62/305,536, filed Mar. 9, 2016; all of which applications are incorporated herein by reference in their entirety. This application is related to International Patent Application No. PCT/US2016/021632, filed Mar. 9, 2016, which application is incorporated herein by reference in its entirety.

SEQUENCE LISTING SUBMITTED VIA EFS-WEB

The entire content of the following electronic submission of the sequence listing via the USPTO EFS-WEB server, as authorized and set forth in MPEP § 1730 II.B.2(a), is incorporated herein by reference in its entirety for all purposes. The sequence listing is within the electronically filed text file that is identified as follows:
File Name: 825601_SeqListing_ST25.txt
Date of Creation: Jun. 22, 2016
Size (bytes): 883,280 bytes

BACKGROUND OF THE INVENTION

The invention relates generally to the field of aptamers capable of binding to microvesicle surface antigens, which are useful as therapeutics in and diagnostics of cancer and/or other diseases or disorders in which microvesicles implicated. The invention further relates to materials and methods for the administration of aptamers capable of binding to microvesicles. The microvesicles may be derived from cells indicative of cancer, including without limitation a breast cancer.

Aptamers are oligomeric nucleic acid molecules having specific binding affinity to molecules, which may be through interactions other than classic Watson-Crick base pairing. Unless otherwise specified, an "aptamer" as the term is used herein can refer to nucleic acid molecules that can be used to characterize a phenotype, regardless of manner of target recognition. Unless other specified, the terms "aptamer," "oligonucleotide," "polynucleotide," or the like may be used interchangeably herein.

Aptamers, like peptides generated by phage display or monoclonal antibodies ("mAbs"), are capable of specifically binding to selected targets and modulating the target's activity, e.g., through binding aptamers may block their target's ability to function. Created by an in vitro selection process from pools of random sequence oligonucleotides, aptamers have been generated for over 100 proteins including growth factors, transcription factors, enzymes, immunoglobulins, and receptors. A typical aptamer is 10-15 kDa in size (30-45 nucleotides), binds its target with sub-nanomolar affinity, and discriminates against closely related targets (e.g., aptamers will typically not bind other proteins from the same gene family). A series of structural studies have shown that aptamers are capable of using the same types of binding interactions (e.g., hydrogen bonding, electrostatic complementarity, hydrophobic contacts, steric exclusion) that drive affinity and specificity in antibody-antigen complexes.

Aptamers have a number of desirable characteristics for use as therapeutics and diagnostics including high specificity and affinity, biological efficacy, and excellent pharmacokinetic properties. In addition, they offer specific competitive advantages over antibodies and other protein biologics, for example:

Speed and control. Aptamers are produced by an entirely in vitro process, allowing for the rapid generation of initial leads, including therapeutic leads. In vitro selection allows the specificity and affinity of the aptamer to be tightly controlled and allows the generation of leads, including leads against both toxic and non-immunogenic targets.

Toxicity and Immunogenicity. Aptamers as a class have demonstrated little or no toxicity or immunogenicity. In chronic dosing of rats or woodchucks with high levels of aptamer (10 mg/kg daily for 90 days), no toxicity is observed by any clinical, cellular, or biochemical measure. Whereas the efficacy of many monoclonal antibodies can be severely limited by immune response to antibodies themselves, it is extremely difficult to elicit antibodies to aptamers most likely because aptamers cannot be presented by T-cells via the MHC and the immune response is generally trained not to recognize nucleic acid fragments.

Administration. Whereas most currently approved antibody therapeutics are administered by intravenous infusion (typically over 2-4 hours), aptamers can be administered by subcutaneous injection (aptamer bioavailability via subcutaneous administration is >80% in monkey studies (Tucker et al., J. Chromatography B. 732: 203-212, 1999)). This difference is primarily due to the comparatively low solubility and thus large volumes necessary for most therapeutic mAbs. With good solubility (>150 mg/mL) and comparatively low molecular weight (aptamer: 10-50 kDa; antibody: 150 kDa), a weekly dose of aptamer may be delivered by injection in a volume of less than 0.5 mL. In addition, the small size of aptamers allows them to penetrate into areas of conformational constrictions that do not allow for antibodies or antibody fragments to penetrate, presenting yet another advantage of aptamer-based therapeutics or prophylaxis.

Scalability and cost. Aptamers are chemically synthesized and are readily scaled as needed to meet production demand for diagnostic or therapeutic applications. Whereas difficulties in scaling production are currently limiting the availability of some biologics and the capital cost of a large-scale protein production plant is enormous, a single large-scale oligonucleotide synthesizer can produce upwards of 100 kg/year and requires a relatively modest initial investment. The current cost of goods for aptamer synthesis at the kilogram scale is estimated at $100/g, comparable to that for highly optimized antibodies.

Stability. Aptamers are chemically robust. They are intrinsically adapted to regain activity following exposure to factors such as heat and denaturants and can be stored for extended periods (>1 yr) at room temperature as lyophilized powders.

INCORPORATION BY REFERENCE

All publications, patents and patent applications mentioned in this specification are herein incorporated by reference to the same extent as if each individual publication, patent or patent application was specifically and individually indicated to be incorporated by reference.

SUMMARY OF THE INVENTION

Compositions and methods of the invention provide aptamers that bind biomarkers of interest such as microvesicle surface antigens or functional fragments of microvesicle surface antigens. In various embodiments, oligonucleotide probes of the invention are used in diagnostic, prognostic or theranostic processes to screen a biological sample for the presence or levels of biomarkers, including without limitation microvesicle surface antigens, determined to provide a relevant readout. The diagnosis may be related to a disease or disorder, e.g., a cancer. In other embodiments, oligonucleotide probes of the invention are chemically modified or composed in a pharmaceutical composition for therapeutic applications.

In an aspect, the invention provides an oligonucleotide comprising a sequence selected from any one of SEQ ID NOs. 1472, 1475, 1477, 1482, and 4151-4325. In a related aspect, the invention provides an oligonucleotide comprising a central sequence comprising a sequence according to any one of SEQ ID NOs. 1472, 1475, 1477, 1482, and 4151-4325, and a 5' region with sequence 5'-CTAGCATGACTGCAGTACGT (SEQ ID NO. 131), a 3' region with sequence 5'-CTGTCTCTTATACACATCTGACGCTGCCGACGA (SEQ ID NO. 132), or both. The oligonucleotides of the invention can be capable of binding to complement protein complex C1q or a subunit thereof.

In another aspect, the invention provides an oligonucleotide comprising the sequence 5'-ACAATCC (SEQ ID NO. 4151), wherein the oligonucleotide is capable of binding to complement protein complex C1q or a subunit thereof. In still another aspect, the invention further provides an oligonucleotide comprising the sequence 5'-ACTATAGAACAATCCACCGCTTTAAATCAACTATCTTA (SEQ ID NO. 1472) or 5'-AACCCAATTCACATACACTCTCACCCCCACTAAACA (SEQ ID NO. 1482), wherein the oligonucleotide is capable of binding to complement protein complex C1q or a subunit thereof.

The C1q subunit targeted by the oligonucleotides of the invention can be the A, B or C subunit. The subunits can carry various post-translational modifications. For example, the C1q A subunit can have at least one modification selected from Table 46.

The invention further provides an oligonucleotide comprising a nucleic acid sequence or a portion thereof that is at least 50, 55, 60, 65, 70, 75, 80, 85, 86, 86, 88, 89, 90, 95, 96, 97, 98, 99 or 100 percent homologous to an oligonucleotide sequence described above.

In another aspect, the plurality of oligonucleotides comprising at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 110, 120, 130, 140, 150, 160, 170 or all oligonucleotide sequences described above. For example, the invention provides a plurality of oligonucleotides comprising at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 2000, 3000, 4000, 5000, 6000, 7000, 8000, 9000, or at least 10000 different oligonucleotide sequences comprising at least one of the sequences 5'-ACAATCC (SEQ ID NO. 4151), 5'-ACTATAGAACAATCCACCGCTTTAAATCAACTATCTTA (SEQ ID NO. 1472) or 5'-AACCCAATTCACATACACTCTCACCCCCACTAAACA (SEQ ID NO. 1482), wherein the oligonucleotide are capable of binding C1q or a subunit thereof.

The oligonucleotide or the plurality of oligonucleotides provided by the invention comprises at least one of DNA, RNA, PNA, and any combination thereof. The oligonucleotide or the plurality of oligonucleotides may comprise at least one functional modification selected from the group consisting of biotinylation, a non-naturally occurring nucleotide, a deletion, an insertion, an addition, and a chemical modification. In some embodiments, the chemical modification comprises at least one of C18, polyethylene glycol (PEG), PEG4, PEG6, PEG8, and PEG12.

In an aspect, the invention provides a method comprising synthesizing the at least one oligonucleotide or the plurality of oligonucleotides provided by the invention.

In another aspect, the invention provides a method comprising contacting a biological sample with the at least one oligonucleotide or the plurality of oligonucleotides provided by the invention. For example, the at least one oligonucleotide or the plurality of oligonucleotides can be as described above. In some embodiments, the method further comprises detecting a presence or level of complement protein complex C1q or a subunit thereof in the biological sample that is bound by the at least one oligonucleotide or at least one member of the plurality of oligonucleotides. Any appropriate method of the detecting the complex can be used. For example, detecting the oligonucleotide/s or other nucleic acids may comprise at least one of sequencing, amplification, hybridization, gel electrophoresis, chromatography, and any combination thereof. Any useful sequencing method can be employed, including without limitation at least one of next generation sequencing, dye termination sequencing, pyrosequencing, and any combination thereof. Detecting the C1q protein, a subunit, or a related protein (such as a protein in complex with C1q) may comprise one or more of an immunoassay, enzyme immunoassay (EIA), enzyme-linked immunosorbent assay (ELISA), enzyme-linked oligonucleotide assay (ELONA), affinity isolation, immunoprecipitation, Western blot, gel electrophoresis, or flow cytometry. One of skill will appreciate that immunoassays can employ various useful reporter systems, including without limitation enzymes, radioactive isotopes, nucleic acid reporters, fluorogenic reporters, electrochemiluminescent tags, or label-free formats.

C1q may be free in solution or part of a larger biological complex. In some cases, the C1q or subunit thereof may be associated with a microvesicle population. As desired, the method of the invention comprises isolating the microvesicle population prior to contacting the sample with the oligonucleotide or plurality of oligonucleotides, after such contacting, or both before and after. The isolating may be in whole or in part. For example, the microvesicle population may be partially isolated from other components in the sample before or after contacting the sample with the oligonucleotide or plurality of oligonucleotides. The invention may use any appropriate techniques to isolate microvesicles. Various techniques of isolating microvesicles are disclosed herein or known in the art, including without limitation affinity purification, filtration, concentration, polymer precipitation, PEG precipitation, ultracentrifugation, a molecular crowding reagent, affinity selection, chromatography, or any combination thereof.

Any desired biological sample can be contacted with the oligonucleotide or plurality of oligonucleotides according to the invention. In various embodiments, the sample comprises a bodily fluid, tissue sample or cell culture. Any appropriate bodily fluid can be contacted, including without limitation whole blood, peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair oil, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood. In certain preferred embodiments, the bodily fluid comprises whole blood or a derivative or fraction thereof, such as sera or plasma. The biological sample may comprise purified C1q, recombinant C1q, both, or fragments thereof. For example, such C1q or subunits thereof can be spiked into the bodily fluid, tissue sample or cell culture sample.

As desired, the method of detecting the presence or level of complement protein complex C1q or a subunit thereof may be used to characterize a phenotype. The phenotype can be any appropriate phenotype, including without limitation a disease or disorder. In such cases, the characterizing may include providing, or assisting in providing, at least one of diagnostic, prognostic and theranostic information for the disease or disorder. Characterizing the phenotype may comprise comparing the presence or level to a reference. Any appropriate reference level can be used. For example, the reference can be the presence or level determined in a sample from at least one individual without the phenotype or from at least one individual with a different phenotype. As a further example, if the phenotype is a disease or disorder, the reference level may be the presence or level determined in a sample from at least one individual without the disease or disorder, or with a different state of the disease or disorder (e.g., in remission, different stage or grade, different prognosis, metastatic versus local, etc).

As noted, the sample can be from a subject suspected of having or being predisposed to a disease or disorder. The disease or disorder can be any disease or disorder that can be assessed by the subject method. For example, the disease or disorder may be a cancer, a premalignant condition, an inflammatory disease, an immune disease, an autoimmune disease or disorder, a pregnancy related disorder, a cardiovascular disease or disorder, a neurological disease or disorder, an infectious disease or pain. In an embodiment, the cancer comprises an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sézary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenström macroglobulinemia; or Wilm's tumor. The premalignant condition can be Barrett's Esophagus. The autoimmune disease can be inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. The cardiovascular disease can be atherosclerosis, congestive heart failure, vulnerable plaque, stroke, ischemia, high blood pressure, stenosis, vessel occlusion or a thrombotic event. The neurological disease can be Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain can be fibromyalgia, chronic neuropathic pain, or peripheral neuropathic pain. The infectious disease can be a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, influenza.

As further described herein, the invention provides a kit comprising a reagent for carrying out the method. Similarly, the invention provides for the use of a reagent for carrying out the method. The reagent can be any useful reagent for carrying out the method. For example, the reagent can be at least one oligonucleotide or a plurality of oligonucleotides as described above, or one or more primers or primer sets for amplification or sequencing of such oligonucleotides. In some embodiments, the reagent comprises at least one binding agent to at least one protein, a binding buffer with or without $MgCl_2$, a sample processing reagent, a microvesicle isolation reagent, a detection reagent, a secondary detection reagent, a wash buffer, an elution buffer, a solid support, and any combination thereof. The microvesicle isolation reagent may comprise at least one of a concentrator unit, a filtration unit, a polymer, PEG, a size exclusion column, a binding agent to a microvesicle antigen, and any combination thereof; and/or the detection or secondary detection agent comprises streptavidin-horse radish peroxide (HRP), a streptavidin-conjugated fluorophore, a streptavidin-conjugated quantum dot, and any combination thereof.

In an aspect, the invention provides a pharmaceutical composition comprising a therapeutically effective amount of the at least one oligonucleotide or the plurality of oligonucleotides of the invention, or a salt thereof, and a pharmaceutically acceptable carrier, diluent, or both. In a related aspect, the invention provides a method of treating or ameliorating a disease or disorder in a subject in need thereof, comprising administering such pharmaceutical composition to the subject. In another related aspect, the invention provides a method of inhibiting C1q in a subject, comprising administering such pharmaceutical composition to the subject. The pharmaceutical composition can be administered in any useful format. In various embodiments, the administering comprises at least one of intradermal, intramuscular, intraperitoneal, intravenous, subcutaneous, intranasal, epidural, oral, sublingual, intracerebral, intravaginal, transdermal, rectal, by inhalation, topical administration, or any combination thereof. The carrier or diluent can be any useful carrier or diluent, as described herein or known in the art.

In an aspect, the invention provides a multipartite construct that comprises a first segment that binds to a first target and a second segment that binds to a second target. As desired, the first segment, the second segment, or both, comprises a sequence selected from any one of SEQ ID NOs. 137-969 and 1072-4325, or a region that is at least 50, 55, 60, 65, 70, 75, 80, 85, 90, 95, 96, 97, 98, 99 or 100 percent homologous thereto.

In a preferred embodiment, the first target comprises a cell-of-origin or disease specific cellular marker, including without limitation a protein marker that may be found on a cellular surface. For example, the first target can be a cancer antigen, a tumor antigen, a cell surface antigen, a microvesicle surface antigen, a cell receptor and/or a membrane antigen. Many useful targets are provided herein. In some embodiments, the first target is selected from any one of Table 3, Table 4, Tables 18-26, or Table 45. The first target can be selected from those provided in the Section "Antitarget and multivalent oligonucleotides" herein. For example, the first target can be selected from the group consisting of CD2, CD4, CD19, CD20, CD22, CD23, CD30, CD33, CD37, CD40, CD44v6, CD52, CD56, CD70, CD74, CD79a, CD80, CD98, CD138, EGFR (Epidermal growth factor receptor), VEGF (Vascular endothelial growth factor), VEGFR1 (Vascular endothelial growth factor receptor 1), PDGFR (Platelet-derived growth factor receptor), RANKL (Receptor activator of nuclear factor kappa-B ligand), GPNMB (Transmembrane glycoprotein Neuromedin B), EphA2 (Ephrin type-A receptor 2), PSMA (Prostate-specific membrane antigen), Cripto (Cryptic family protein 1B), EpCAM (Epithelial cell adhesion molecule), CTLA4 (Cytotoxic T-Lymphocyte Antigen 4), IGF-IR (Type 1 insulin-like growth factor receptor), GP3 (M13 bacteriophage), GP9 (Glycoprotein IX), CD42a, GP 40 (Glycoprotein 40 kDa), GPC3 (glypican-3), GPC1 (glypican-1), TRAILR1 (Tumor necrosis factor-related apoptosis-inducing ligand receptor 1), TRAILRII (Tumor necrosis factor-related apoptosis-inducing ligand receptor II), FAS (Type II transmembrane protein), PS (phosphatidyl serine) lipid, Muc1 (Mucin 1, PEM), Muc18, CD146, $\alpha5\beta1$ integrin, $\alpha4\beta1$ integrin, $\alpha v$ integrin (Vitronectin Receptor), Chondrolectin, CAIX (Carbonic anhydrase IX), GD2 ganglioside, GD3 ganglioside, GM1 ganglioside, Lewis Y antigen, Mesothelin, HER2 (Human Epidermal Growth factor 2), HER3, HER4, FN14 (Fibroblast Growth Factor Inducible 14), CS1 (Cell surface glycoprotein, CD2 subset 1, CRACC, SLAMF7, CD319), 41BB CD137, SIP (Siah-1 Interacting Protein), CTGF (Connective tissue growth factor), HLADR (MHC class II cell surface receptor), PD-1 (Programmed Death 1, Type I membrane protein, PD-L1 (Programmed Death Ligand 1), PD-L2 (Programmed Death Ligand 2), IL-2 (Interleukin-2), IL-8 (Interleukin-8), IL-13 (Interleukin-13), PIGF (Phosphatidylinositol-glycan biosynthesis class F protein), NRP1 (Neuropilin-1), ICAM1, CD54, GC182 (Claudin 18.2), Claudin, HGF (Hepatocyte growth factor), CEA (Carcinoembryonic antigen), $LT\beta R$ (lymphotoxin $\beta$ receptor), Kappa Myeloma, Folate Receptor alpha, GRP78 (BIP, 78 kDa Glucose-regulated protein), A33 antigen, PSA (Prostate-specific antigen), CA 125 (Cancer antigen 125 or carbohydrate antigen 125), CA19.9, CA15.3, CA242, leptin, prolactin, osteopontin, IGF-II (Insulin-like growth factor 2), fascin, sPIgR (secreted chain of polymorphic immunoglobulin receptor), 14-3-3 eta protein, 5T4, ETA (epithelial tumor antigen), MAGE (Melanoma-associated antigen), MAPG (Melanoma-associated proteoglycan, NG2), vimentin, EPCA-1 (Early prostate cancer antigen-2), TAG-72 (Tumor-associated glycoprotein 72), factor VIII, Neprilysin (Membrane metallo-endopeptidase), 17-1 A (Epithelial cell surface antigen 17-1A), nucleolin, nucleophosmin, and any combination thereof. In some embodiments, the first target comprises CD20. In still other embodiments, the first target comprises cMet.

As described herein, the invention contemplates various configuration of the multipartite construct. See, e.g., FIGS. 23A-D herein and related discussion herein. In preferred embodiments, the first segment comprises an oligonucleotide. Such construct may further comprise a first oligonucleotide primer region and/or a second oligonucleotide primer region surrounding the first segment.

In some embodiments, the second target of the multipartite construct of the invention comprises an immunomodulatory molecule. For example, the immunomodulatory molecule may be selected from at least one of a member of the innate immune system, a member of the complement system, C1q, C1r, C1s, C1, C3a, C3b, C3d, C5a, C2, C4, and any combination thereof. In some embodiments, the second target comprises C1q or a subunit thereof, e.g., the A, B or C subunit. The second target may comprise any number of post-translational modifications. For example, when the immunomodulatory molecule comprises C1q A, the A subunit may have at least one modification selected from Table 46.

As noted above, the invention contemplates various configuration of the multipartite construct. In various embodiments of the invention, the second segment comprises an antibody or oligonucleotide. And in preferred embodiments, the second segment comprises an oligonucleotide. Such a second segment may further comprise a first oligonucleotide primer region and/or a second oligonucleotide primer region surrounding the second segment. The second segment may comprise an oligonucleotide as provided by the invention. For example, the oligonucleotide can be as described above, including without limitation a sequence selected from any one of SEQ ID NOs. 137-969 and 1072-4325, or a region that is at least 50, 55, 60, 65, 70, 75, 80, 85, 90, 95, 96, 97, 98, 99 or 100 percent homologous thereto.

As desired, the multipartite construct of the invention can include a linker region between the first segment and second segment. The linker region can be chosen to achieve any desired purpose, such as modulate the distance between the first and second targets, e.g., to relieve steric hindrance or to bring the targets into close proximity. The linker can also provide certain functionalities, including without limitation an immunostimulatory sequence, an anti-proliferative sequence, a pro-apoptotic sequence, or some combination thereof. In an embodiment, the linker region comprises one or more CpG motif. In another embodiment, the linker comprises a polyG sequence. In still other embodiments, the multipartite construct of the invention comprises an immunostimulating moiety, a membrane disruptive moiety, or both.

The multipartite construct of the invention can be modified to comprise at least one oligonucleotide chemical modification. Various useful modifications are disclosed herein or known in the art. In some embodiments, the modification is selected from the group consisting: of a chemical substitution at a sugar position; a chemical substitution at a phosphate position; a chemical substitution at a base position of the nucleic acid; and any combination thereof. The modification can be selected from the group consisting of: incorporation of a modified nucleotide, 3' capping, conjugation to an amine linker, conjugation to a high molecular weight, non-immunogenic compound, conjugation to a lipophilic compound, conjugation to a drug, conjugation to a cytotoxic moiety, labeling with a radioisotope, and any combination thereof. In a preferred embodiment, the non-immunogenic, high molecular weight compound is polyalkylene glycol, such as polyethylene glycol.

In preferred embodiments, the multipartite construct comprises an oligonucleotide polymer. Such a construct can be flanked by a first oligonucleotide primer region and a second oligonucleotide primer region. In various embodiments, the first target comprises CD20 or cMET and the second segment comprises an oligonucleotide provided by the invention, e.g., an oligonucleotide that can bind C1q or a subunit thereof.

In a related aspect, the invention provides a pharmaceutical composition comprising a therapeutically effective amount of the multipartite construct described herein, or a salt thereof, and a pharmaceutically acceptable carrier, diluent or both. In a related aspect, the invention provides a method of treating or ameliorating a disease or disorder in a subject in need thereof, comprising administering such pharmaceutical composition to the subject. The pharmaceutical composition can be administered in any useful format. In various embodiments, the administering comprises at least one of intradermal, intramuscular, intraperitoneal, intravenous, subcutaneous, intranasal, epidural, oral, sublingual, intracerebral, intravaginal, transdermal, rectal, by inhalation, topical administration, or any combination thereof. The carrier or diluent can be any useful carrier or diluent, as described herein or known in the art.

The first target of the multipartite construct may be determined in a personalized manner. See, e.g., FIG. 23E and related discussion herein. For example, the first target of the multipartite construct can be determined by: a) contacting a biological sample from the subject with an oligonucleotide probe library such as described herein (see, e.g., Examples 16-18, 21-22, and 26-32); b) identifying members of the probe library that bound to the biological sample upon contact in a) (see, e.g., Examples 16-18, 21-22, and 26-32); and c) determining the first target as a binding target of a member of the probe library identified in b) (see, e.g., Examples 9, 23 and 35), thereby providing a personalized medical treatment to the subject. The biological sample may comprise any useful sample from the subject, including without limitation a biopsy sample, a tissue removed during a surgical procedure, a bodily fluid, a frozen section, a cell culture, or a fraction, derivative or components of any thereof. The bodily fluid can be any useful fluid from the subject, including without peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen (including prostatic fluid), Cowper's fluid or pre-ejaculatory fluid, female ejaculate, sweat, fecal matter, tears, cyst fluid, pleural fluid, peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids.

A method of inducing killing of a cell, comprising contacting the cell with a multipartite construct of the invention as provided above. In such a construct, the second segment may comprise an oligonucleotide provided by the invention. For example, the construct may one that binds a member of the complement system, including without limitation the C1 complex, C1q, or a subunit thereof, and can induce complement mediated lysis of the cell. In some embodiments, the cell that is killed comprises a disease or disorder.

As described above, the multipartite construct of the invention can be administered to a subject to treat a disease or disorder, or to induce cell killing. In various embodiments, the disease or disorder comprises a cancer, a premalignant condition, an inflammatory disease, an immune disease, an autoimmune disease or disorder, a cardiovascular disease or disorder, neurological disease or disorder, infectious disease or pain. The cancer can include without limitation one of acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sézary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenström macroglobulinemia; or Wilm's tumor. The premalignant condition can include without limitation Barrett's Esophagus. The autoimmune disease can include without limitation one of inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. The cardiovascular disease can include without limitation one of atherosclerosis, congestive heart failure, vulnerable plaque, stroke, ischemia, high blood pressure, stenosis, vessel occlusion or a thrombotic event. The neurological disease can include without limitation one of Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain can include without limitation one of fibromyalgia, chronic neuropathic pain, or peripheral neuropathic pain. The infectious disease can include without limitation one of a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, or influenza.

In an aspect, the invention provides a kit comprising a multipartite construct or a pharmaceutical composition provided by the invention, e.g., as described above. In a related aspect, the invention provides a kit comprising a reagent for carrying out the methods making use of such multipartite construct or a pharmaceutical composition. Similarly, the invention provides use of a reagent for carrying out the methods making use of such multipartite construct or a pharmaceutical composition. The invention also provides use of a reagent for the manufacture of a kit or reagent for carrying out the methods making use of such multipartite construct or a pharmaceutical composition. The invention further contemplates use of a reagent for the manufacture of a medicament for carrying out the method methods making use of such multipartite construct or a pharmaceutical composition. In such kits or uses, the reagent may comprise a multipartite construct or a pharmaceutical composition provided by the invention, e.g., as described above.

In an aspect, the invention provides a method of detecting at least one microvesicle in a biological sample comprising contacting the biological sample with at least one binding agent to at least one microvesicle surface antigen and detecting the at least one microvesicle recognized by the binding agent to the at least one protein. In an embodiment, the at least one microvesicle surface antigen is selected from any one of Tables 18, 26 or 45. The at least one protein can be a complement protein or an immunoglobulin. For example, the complement protein can be C1q, a subunit thereof (e.g., A, B or C), C4b, or any combination thereof. The immunoglobulin may comprise IgM, IgG, or both. See Example 35 herein. The at least one binding agent may comprise any useful binding agent, including without limitation a nucleic acid, DNA molecule, RNA molecule, antibody, antibody fragment, aptamer, peptoid, zDNA, peptide nucleic acid (PNA), locked nucleic acid (LNA), lectin, peptide, dendrimer, membrane protein labeling agent, chemical compound, or a combination thereof. In some embodiments, the at least one binding agent comprises at least one oligonucleotide, such as an oligonucleotide probe as provided by the invention.

The at least one binding agent can be used to capture and/or detect the at least one microvesicle. Methods of detecting biomarkers and microvesicle using binding agents are provided herein. See, e.g., FIGS. 2A-B, which figures describe sandwich assay formats. In some embodiments, the at least one binding agent used to capture the at least one microvesicle is bound to a substrate. Any useful substrate can be used, including without limitation a planar array, a column matrix, or a microbead. See, e.g., FIGS. 2A-B. In some embodiments, the at least one binding agent used to detect the at least one microvesicle is labeled. Various useful labels are provided herein or known in the art, including without limitation a magnetic label, a fluorescent moiety, an enzyme, a chemiluminescent probe, a metal particle, a non-metal colloidal particle, a polymeric dye particle, a pigment molecule, a pigment particle, an electrochemically active species, a semiconductor nanocrystal, a nanoparticle, a quantum dot, a gold particle, a fluorophore, or a radioactive label.

In an embodiment, the detecting is used to characterize a phenotype. The phenotype can be any appropriate phenotype of interest. In some embodiments, the phenotype is a disease or disorder. The characterizing may comprise providing, or assisting in providing, diagnostic, prognostic and/or theranostic information for the disease or disorder. The characterizing may be performed by comparing a presence or level of the at least one microvesicle to a reference. The reference can be selected per the characterizing to be performed. For example, when the phenotype comprises a disease or disorder, the reference may comprise a presence or level of the at least one microvesicle in a sample from an individual or group of individuals without the disease or disorder. The comparing can be determining whether the presence or level of the microvesicle differs from that of the reference. In some embodiments, the detected at least one microvesicle is found at higher levels in a healthy sample as compared to a diseased sample. In another embodiment, the detected at least one microvesicle is found at higher levels in a diseased sample as compared to a healthy sample. When multiplex assays are performed, e.g., using a plurality of binding agents to different biomarkers, some microvesicle antigens may be observed at a higher level in the biological samples as compared to the reference whereas other microvesicle antigens may be observed at a lower level in the biological samples as compared to the reference.

The method can be used to detect the at least one microvesicle in any appropriate biological sample. For example, the biological sample may comprise a bodily fluid, tissue sample or cell culture. The bodily fluid or tissue sample can be from a subject having or suspected of having a medical condition, a disease or a disorder. Thus, the method can be used to provide a diagnostic, prognostic, or theranostic read out for the subject. Any appropriate bodily fluid can be used, including without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair oil, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood.

The method of the invention can be used to detect or characterize any appropriate disease or disorder of interest, including without limitation Breast Cancer, Alzheimer's disease, bronchial asthma, Transitional cell carcinoma of the bladder, Giant cellular osteoblastoclastoma, Brain Tumor, Colorectal adenocarcinoma, Chronic obstructive pulmonary disease (COPD), Squamous cell carcinoma of the cervix, acute myocardial infarction (AMI)/acute heart failure, Chron's Disease, diabetes mellitus type II, Esophageal carcinoma, Squamous cell carcinoma of the larynx, Acute and chronic leukemia of the bone marrow, Lung carcinoma, Malignant lymphoma, Multiple Sclerosis, Ovarian carcinoma, Parkinson disease, Prostate adenocarcinoma, psoriasis, Rheumatoid Arthritis, Renal cell carcinoma, Squamous cell carcinoma of skin, Adenocarcinoma of the stomach, carcinoma of the thyroid gland, Testicular cancer, ulcerative colitis, or Uterine adenocarcinoma.

In some embodiments, the disease or disorder comprises a cancer, a premalignant condition, an inflammatory disease, an immune disease, an autoimmune disease or disorder, a cardiovascular disease or disorder, neurological disease or disorder, infectious disease or pain. The cancer can include without limitation one of acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sézary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenström macroglobulinemia; or Wilm's tumor. The premalignant condition can include without limitation Barrett's Esophagus. The autoimmune disease can include without limitation one of inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. The cardiovascular disease can include without limitation one of atherosclerosis, congestive heart failure, vulnerable plaque, stroke, ischemia, high blood pressure, stenosis, vessel occlusion or a thrombotic event. The neurological disease can include without limitation one of Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain can include without limitation one of fibromyalgia, chronic neuropathic pain, or peripheral neuropathic pain. The infectious disease can include without limitation one of a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, or influenza.

In a related aspect, the invention provides a kit comprising a reagent for carrying out the methods herein. In still another related aspect, the invention provides for use of a reagent for carrying out the methods. The reagent may comprise at least one binding agent to the at least one protein. The binding agent may be an oligonucleotide as provided herein, one or more primer for amplification or sequencing of such oligonucleotide, a binding buffer with or without MgCl$_2$, a sample processing reagent, a microvesicle isolation reagent, a detection reagent, a secondary detection reagent, a wash buffer, an elution buffer, a solid support, and any combination thereof. In some embodiments, the microvesicle isolation reagent comprises at least one of a concentrator unit, a filtration unit, a polymer, PEG, a size exclusion column, a binding agent to a microvesicle antigen, and any combination thereof; and/or the detection or secondary detection agent comprises streptavidin-horse radish peroxidase (HRP), a streptavidin-conjugated fluorophore, a streptavidin-conjugated quantum dot, and any combination thereof.

BRIEF DESCRIPTION OF THE DRAWINGS

FIGS. 2A-2F illustrate methods of assessing biomarkers such as microvesicle surface antigens. FIG. 2A is a schematic of a planar substrate coated with a capture agent, such as an aptamer or antibody, which captures vesicles expressing the target antigen of the capture agent. The capture agent may bind a protein expressed on the surface of vesicles shed from diseased cells ("disease vesicle"). The detection agent, which may also be an aptamer or antibody, carries a detectable label, here a fluorescent signal. The detection agent binds to the captured vesicle and provides a detectable signal via its fluorescent label. The detection agent can detect an antigen that is generally associated with vesicles, or is associated with a cell-of-origin or a disease, e.g., a cancer. FIG. 2B is a schematic of a particle bead conjugated with a capture agent, which captures vesicles expressing the target antigen of the capture agent. The capture agent may bind a protein expressed on the surface of vesicles shed from diseased cells ("disease vesicle"). The detection agent, which may also be an aptamer or antibody, carries a detectable label, here a fluorescent signal. The detection agent binds to the captured vesicle and provides a detectable signal via its fluorescent label. The detection agent can detect an antigen that is generally associated with vesicles, or is associated with a cell-of-origin or a disease, e.g., a cancer. FIG. 2C is an example of a screening scheme that can be performed by using different combinations of capture and detection agents to the indicated biomarkers. The biomarker combinations can be detected using assays as shown in FIGS. 2A-2B. FIGS. 2D-2E present illustrative schemes for capturing and detecting vesicles to characterize a phenotype. FIG. 2F presents illustrative schemes for assessing vesicle payload to characterize a phenotype.

FIG. 3A illustrates a secondary structure of a 32-mer oligonucleotide, Aptamer 4, with sequence 5'-CCCCCCGAATCACATGACTTGGGCGGGGGTCG (SEQ ID NO. 1). In the figure, the sequence is shown with 6 thymine nucleotides added to the end, which can act as a spacer to attach a biotin molecule. This particular oligo has a high binding affinity to the target, EpCAM (see Table 5). Additional candidate EpCAM binders are identified by modeling the entire database of sequenced oligos to the secondary structure of this oligo. FIG. 3B illustrates another 32-mer oligo with sequence 5'-ACCGGATAGCGGTTGGAGGCGTGCTCCACTCG (SEQ ID NO. 2) that has a different secondary structure than the aptamer in FIG. 3A. This aptamer is also shown with a 6-thymine tail.

FIGS. 6A-D illustrate the use of an anti-EpCAM aptamer (Aptamer 4; SEQ ID NO. 1) to detect a microvesicle population. Vesicles in patient plasma samples were captured using bead-conjugated antibodies to the indicated microvesicle surface antigens: A) EGFR; B) PBP; C) EpCAM; D) KLK2. Fluorescently labeled Aptamer 4 was used as a detector in the microbead assay. The figure shows average median fluorescence values (MFI values) for three cancer (C1-C3) and three normal samples (N1-N3) in each plot. In each plot, the samples from left to right are ordered as: C1, C2, C3, N1, N2, N3.

FIG. 7A illustrates the sequence of EPCAM aptamer CAR003 (SEQ ID NO. 4). FIG. 7B illustrates the optimal secondary structure of CAR003 with a minimum free energy (ΔG) of −30.00 kcal/mol. For purposes of illustration, the aptamer is shown as an RNA aptamer (SEQ ID NO. 5) corresponding to the sequence in FIG. 7A.

FIGS. 8A-8D illustrates methods to attach microvesicles to a substrate. FIG. 8A illustrates direct conjugation of a carboxylated microsphere to a vesicle surface antigen. FIG. 8B illustrates anchoring of a microvesicle to a microsphere via a biotin functionalized lipid anchor. FIG. 8C illustrates antibody binding to a vesicle surface antigen, wherein the antibody is conjugated to a carboxylated microsphere. FIG. 8D illustrates aptamer binding to a vesicle surface antigen, wherein the aptamer is conjugated to a carboxylated microsphere.

FIGS. 12A-12G illustrate using an oligonucleotide probe library to differentiate cancer and non-cancer samples.

FIGS. 14A-G illustrate use of oligonucleotides that differentiate microvesicles in breast cancer plasma from normal controls.

FIGS. 16A-B illustrate a model generated using a training (FIG. 16A) and test (FIG. 16B) set from a round of cross validation. The AUC for the test set was 0.803. Another exemplary round of cross-validation is shown in FIGS. 16C-D with training (FIG. 16C) and test (FIG. 16D) sets. The AUC for the test set was 0.678.

FIGS. 17A-E show a photo-cleavable Biotin mediated purification of an oligonucleotide library.

FIG. 19A is a schematic 1900 showing an assay configuration that can be used to detect and/or quantify a target of interest. In the figure, capture aptamer 1902 is attached to substrate 1901. Target of interest 1903 is bound by capture aptamer 1902. Detection aptamer 1904 is also bound to target of interest 1903. Detection aptamer 1904 carries label 1905 which can be detected to identify target captured to substrate 1901 via capture aptamer 1902. FIG. 19B is a schematic 1910 showing use of an aptamer pool to characterize a phenotype. A pool of aptamers to a target of interest is provided 1911. The pool is contacted with a test sample to be characterized 1912. The mixture is washed to remove unbound aptamers. The remaining aptamers are disassociated and collected 1913. The collected aptamers are identified 1914 and the identity of the retained aptamers is used to characterize the phenotype 1915. FIG. 19C is a schematic 1920 showing an implementation of the method in FIG. 19B. A pool of aptamers identified as binding a microvesicle population is provided 1919. The input sample comprises microvesicles that are isolated from a test sample 1920. The pool is contacted with the isolated microvesicles to be characterized 1923. The mixture is washed to remove unbound aptamers and the remaining aptamers are disassociated and collected 1925. The collected aptamers are identified and the identity of the retained aptamers is used to characterize the phenotype 1926.

FIGS. 22A-D shows characterization of breast cancer samples as cancer or non-cancer using two different but related oligonucleotide probe libraries.

FIGS. 23A-E illustrate oligonucleotide constructs that recognize immunomodulatory (IMD) targets.

DETAILED DESCRIPTION OF THE INVENTION

Figure 1:
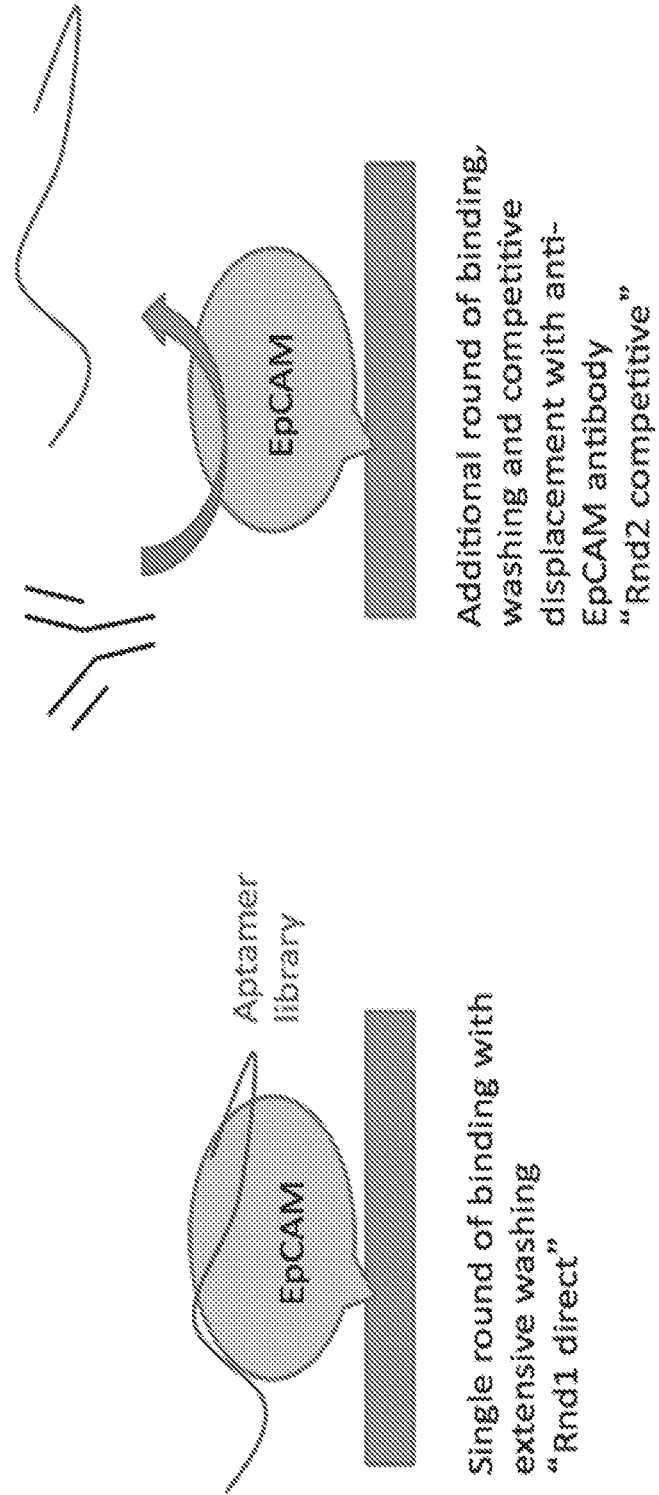
FIG. 1 illustrates a competitive assay selection strategy: the random pool of aptamer (the library) is incubated with the target protein, in this case, EpCAM. After washing and elution from the target, the eluted aptamers are again added to the target and allowed to bind. The antibody is then added to the reaction, competing with the aptamers at the epitope of the antibody. The aptamers displaced by the antibody are then collected.

The details of one or more embodiments of the invention are set forth in the accompanying description below. Although any methods and materials similar or equivalent to those described herein can be used in the practice or testing of the present invention, the preferred methods and materials are now described. Other features, objects, and advantages of the invention will be apparent from the description. In the specification, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present Specification will control.

Disclosed herein are compositions and methods that can be used to assess a biomarker profile, which can include a presence or level of one or more biomarkers. The compositions and methods of the invention comprise the use of oligonucleotide probes (aptamers) that bind microvesicle surface antigens or a functional fragment thereof. The antigens typically comprise proteins or polypeptides but can be any useful component displayed on a microvesicle surface including nucleic acids, lipids and/or carbohydrates. In general, the oligonucleotides disclosed are synthetic nucleic acid molecules, including DNA and RNA, and variations thereof. Unless otherwise specified, the oligonucleotide probes can be synthesized in DNA or RNA format or as hybrid molecules as desired. The methods disclosed comprise diagnostic processes and techniques using one or more aptamer of the invention, to determine the level or presence of relevant microvesicle surface antigens or a functional fragment thereof. Alternatively, an oligonucleotide probe of the invention can also be used as a binding agent to capture, isolate, or enrich, a cell, cell fragment, vesicle or any other fragment or complex that comprises the antigen or functional fragments thereof.

The compositions and methods of the invention comprise individual oligonucleotides that are identified for use in assessing a biomarker profile. The invention further discloses compositions and methods of oligonucleotide pools that can be used to detect a biomarker profile in a given sample.

Oligonucleotide probes and sequences disclosed in the compositions and methods of the invention may be identified herein in the form of DNA or RNA. Unless otherwise specified, one of skill in the art will appreciate that an oligonucleotide may generally be synthesized as either form of nucleic acid and carry various chemical modifications and remain within the scope of the invention. The term aptamer may be used in the art to refer to a single oligonucleotide that binds specifically to a target of interest through mechanisms other than Watson crick base pairing, similar to binding of a monoclonal antibody to a particular antigen. Within the scope of this disclosure and unless stated explicitly or otherwise implicit in context, the terms aptamer, oligonucleotide and oligonucleotide probe, and variations thereof, may be used interchangeably to refer to an oligonucleotide capable of distinguishing biological entities of interest (e.g., biomarkers) whether or not the specific entity has been identified or whether the precise mode of binding has been determined.

An oligonucleotide probe of the invention can also be used to provide in vitro or in vivo detection or imaging, to provide any appropriate diagnostic readout (e.g., diagnostic, prognostic or theranostic).

Separately, an oligonucleotide probe of the invention can also be used for treatment or as a therapeutic to specifically target a cell, tissue or organ.

Aptamers

SELEX. A suitable method for generating an aptamer is with the process entitled "Systematic Evolution of Ligands by Exponential Enrichment" ("SELEX") generally described in, e.g., U.S. patent application Ser. No. 07/536, 428, filed Jun. 11, 1990, now abandoned, U.S. Pat. No. 5,475,096 entitled "Nucleic Acid Ligands", and U.S. Pat. No. 5,270,163 (see also WO 91/19813) entitled "Nucleic Acid Ligands". Each SELEX-identified nucleic acid ligand, i.e., each aptamer, is a specific ligand of a given target compound or molecule. The SELEX process is based on the unique insight that nucleic acids have sufficient capacity for forming a variety of two- and three-dimensional structures and sufficient chemical versatility available within their monomers to act as ligands (i.e., form specific binding pairs) with virtually any chemical compound, whether monomeric or polymeric. Molecules of any size or composition can serve as targets.

SELEX relies as a starting point upon a large library or pool of single stranded oligonucleotides comprising randomized sequences. The oligonucleotides can be modified or unmodified DNA, RNA, or DNA/RNA hybrids. In some examples, the pool comprises 100% random or partially random oligonucleotides. In other examples, the pool comprises random or partially random oligonucleotides containing at least one fixed and/or conserved sequence incorporated within randomized sequence. In other examples, the pool comprises random or partially random oligonucleotides containing at least one fixed and/or conserved sequence at its 5' and/or 3' end which may comprise a sequence shared by all the molecules of the oligonucleotide pool. Fixed sequences are sequences such as hybridization sites for PCR primers, promoter sequences for RNA polymerases (e.g., T3, T4, T7, and SP6), restriction sites, or homopolymeric sequences, such as poly A or poly T tracts, catalytic cores, sites for selective binding to affinity columns, and other sequences to facilitate cloning and/or sequencing of an oligonucleotide of interest. Conserved sequences are sequences, other than the previously described fixed sequences, shared by a number of aptamers that bind to the same target.

The oligonucleotides of the pool preferably include a randomized sequence portion as well as fixed sequences necessary for efficient amplification. Typically the oligonucleotides of the starting pool contain fixed 5' and 3' terminal sequences which flank an internal region of 30-50 random nucleotides. The randomized nucleotides can be produced in a number of ways including chemical synthesis and size selection from randomly cleaved cellular nucleic acids. Sequence variation in test nucleic acids can also be introduced or increased by mutagenesis before or during the selection/amplification iterations.

The random sequence portion of the oligonucleotide can be of any length and can comprise ribonucleotides and/or deoxyribonucleotides and can include modified or non-natural nucleotides or nucleotide analogs. See, e.g. U.S. Pat. Nos. 5,958,691; 5,660,985; 5,958,691; 5,698,687; 5,817,635; 5,672,695, and PCT Publication WO 92/07065. Random oligonucleotides can be synthesized from phosphodiester-linked nucleotides using solid phase oligonucleotide synthesis techniques well known in the art. See, e.g., Froehler et al., Nucl. Acid Res. 14:5399-5467 (1986) and Froehler et al., Tet. Lett. 27:5575-5578 (1986). Random oligonucleotides can also be synthesized using solution phase methods such as triester synthesis methods. See, e.g., Sood et al., Nucl. Acid Res. 4:2557 (1977) and Hirose et al., Tet. Lett., 28:2449 (1978). Typical syntheses carried out on automated DNA synthesis equipment yield $10^{14}$-$10^{16}$ individual molecules, a number sufficient for most SELEX experiments. Sufficiently large regions of random sequence in the sequence design increases the likelihood that each synthesized molecule is likely to represent a unique sequence.

The starting library of oligonucleotides may be generated by automated chemical synthesis on a DNA synthesizer. To synthesize randomized sequences, mixtures of all four nucleotides are added at each nucleotide addition step during the synthesis process, allowing for random incorporation of nucleotides. As stated above, in one embodiment, random oligonucleotides comprise entirely random sequences; however, in other embodiments, random oligonucleotides can comprise stretches of nonrandom or partially random sequences. Partially random sequences can be created by adding the four nucleotides in different molar ratios at each addition step.

The starting library of oligonucleotides may be for example, RNA, DNA, or RNA/DNA hybrid. In those instances where an RNA library is to be used as the starting library it is typically generated by transcribing a DNA library in vitro using T7 RNA polymerase or modified T7 RNA polymerases and purified. The library is then mixed with the target under conditions favorable for binding and subjected to step-wise iterations of binding, partitioning and amplification, using the same general selection scheme, to achieve virtually any desired criterion of binding affinity and selectivity. More specifically, starting with a mixture containing the starting pool of nucleic acids, the SELEX method includes steps of: (a) contacting the mixture with the target under conditions favorable for binding; (b) partitioning unbound nucleic acids from those nucleic acids which have bound specifically to target molecules; (c) dissociating the nucleic acid-target complexes; (d) amplifying the nucleic acids dissociated from the nucleic acid-target complexes to yield a ligand-enriched mixture of nucleic acids; and (e) reiterating the steps of binding, partitioning, dissociating and amplifying through as many cycles as desired to yield highly specific, high affinity nucleic acid ligands to the target molecule. In those instances where RNA aptamers are being selected, the SELEX method further comprises the steps of: (i) reverse transcribing the nucleic acids dissociated from the nucleic acid-target complexes before amplification in step (d); and (ii) transcribing the amplified nucleic acids from step (d) before restarting the process.

Within a nucleic acid mixture containing a large number of possible sequences and structures, there is a wide range of binding affinities for a given target. A nucleic acid mixture comprising, for example, a 20 nucleotide randomized segment can have $4^{20}$ candidate possibilities. Those which have the higher affinity constants for the target are most likely to bind to the target. After partitioning, dissociation and amplification, a second nucleic acid mixture is generated, enriched for the higher binding affinity candidates. Additional rounds of selection progressively favor better ligands until the resulting nucleic acid mixture is predominantly composed of only one or a few sequences. These can then be cloned, sequenced and individually tested for binding affinity as pure ligands or aptamers.

Cycles of selection and amplification are repeated until a desired goal is achieved. In the most general case, selection/amplification is continued until no significant improvement in binding strength is achieved on repetition of the cycle. The method is typically used to sample approximately $10^{14}$ different nucleic acid species but may be used to sample as many as about $10^{18}$ different nucleic acid species. Generally, nucleic acid aptamer molecules are selected in a 5 to 20 cycle procedure. In one embodiment, heterogeneity is introduced only in the initial selection stages and does not occur throughout the replicating process.

In one embodiment of SELEX, the selection process is so efficient at isolating those nucleic acid ligands that bind most strongly to the selected target, that only one cycle of selection and amplification is required. Such an efficient selection may occur, for example, in a chromatographic-type process wherein the ability of nucleic acids to associate with targets bound on a column operates in such a manner that the column is sufficiently able to allow separation and isolation of the highest affinity nucleic acid ligands.

In many cases, it is not necessarily desirable to perform the iterative steps of SELEX until a single nucleic acid ligand is identified. The target-specific nucleic acid ligand solution may include a family of nucleic acid structures or motifs that have a number of conserved sequences and a number of sequences which can be substituted or added without significantly affecting the affinity of the nucleic acid ligands to the target. By terminating the SELEX process prior to completion, it is possible to determine the sequence of a number of members of the nucleic acid ligand solution family. The invention provides for the identification of aptamer pools and uses thereof that jointly can be used to characterize a test sample. For example, the aptamer pools can be identified through rounds of positive and negative selection to identify microvesicle indicative of a disease or condition. The invention further provides use of such aptamer pools to detect and/or quantify such microvesicles in a sample, thereby allowing a diagnosis, prognosis or theranosis to be provided.

A variety of nucleic acid primary, secondary and tertiary structures are known to exist. The structures or motifs that have been shown most commonly to be involved in non-Watson-Crick type interactions are referred to as hairpin loops, symmetric and asymmetric bulges, pseudoknots and myriad combinations of the same. Almost all known cases of such motifs suggest that they can be formed in a nucleic acid sequence of no more than 30 nucleotides. For this reason, it is often preferred that SELEX procedures with contiguous randomized segments be initiated with nucleic acid sequences containing a randomized segment of between about 20 to about 50 nucleotides and in some embodiments, about 30 to about 40 nucleotides. In one example, the 5'-fixed:random:3'-fixed sequence comprises a random sequence of about 30 to about 50 nucleotides.

The core SELEX method has been modified to achieve a number of specific objectives. For example, U.S. Pat. No. 5,707,796 describes the use of SELEX in conjunction with gel electrophoresis to select nucleic acid molecules with specific structural characteristics, such as bent DNA. U.S. Pat. No. 5,763,177 describes SELEX based methods for selecting nucleic acid ligands containing photoreactive groups capable of binding and/or photocrosslinking to and/or photoinactivating a target molecule. U.S. Pat. Nos. 5,567,588 and 5,861,254 describe SELEX based methods which achieve highly efficient partitioning between oligonucleotides having high and low affinity for a target molecule. U.S. Pat. No. 5,496,938 describes methods for obtaining improved nucleic acid ligands after the SELEX process has been performed. U.S. Pat. No. 5,705,337 describes methods for covalently linking a ligand to its target.

SELEX can also be used to obtain nucleic acid ligands that bind to more than one site on the target molecule, and to obtain nucleic acid ligands that include non-nucleic acid species that bind to specific sites on the target. SELEX provides means for isolating and identifying nucleic acid ligands which bind to any envisionable target, including large and small biomolecules such as nucleic acid-binding proteins and proteins not known to bind nucleic acids as part of their biological function as well as lipids, cofactors and other small molecules. For example, U.S. Pat. No. 5,580,737 discloses nucleic acid sequences identified through SELEX which are capable of binding with high affinity to caffeine and the closely related analog, theophylline.

Counter-SELEX is a method for improving the specificity of nucleic acid ligands to a target molecule by eliminating nucleic acid ligand sequences with cross-reactivity to one or more non-target molecules. Counter-SELEX is comprised of the steps of: (a) preparing a candidate mixture of nucleic acids; (b) contacting the candidate mixture with the target, wherein nucleic acids having an increased affinity to the target relative to the candidate mixture may be partitioned from the remainder of the candidate mixture; (c) partitioning the increased affinity nucleic acids from the remainder of the candidate mixture; (d) dissociating the increased affinity nucleic acids from the target; e) contacting the increased affinity nucleic acids with one or more non-target molecules such that nucleic acid ligands with specific affinity for the non-target molecule(s) are removed; and (f) amplifying the nucleic acids with specific affinity only to the target molecule to yield a mixture of nucleic acids enriched for nucleic acid sequences with a relatively higher affinity and specificity for binding to the target molecule. As described above for SELEX, cycles of selection and amplification are repeated until a desired goal is achieved.

One potential problem encountered in the use of nucleic acids as therapeutics and vaccines is that oligonucleotides in their phosphodiester form may be quickly degraded in body fluids by intracellular and extracellular enzymes such as endonucleases and exonucleases before the desired effect is manifest. The SELEX method thus encompasses the identification of high-affinity nucleic acid ligands containing modified nucleotides conferring improved characteristics on the ligand, such as improved in vivo stability or improved delivery characteristics. Examples of such modifications include chemical substitutions at the ribose and/or phosphate and/or base positions. SELEX identified nucleic acid ligands containing modified nucleotides are described, e.g., in U.S. Pat. No. 5,660,985, which describes oligonucleotides containing nucleotide derivatives chemically modified at the 2' position of ribose, 5' position of pyrimidines, and 8' position of purines, U.S. Pat. No. 5,756,703 which describes oligonucleotides containing various 2'-modified pyrimidines, and U.S. Pat. No. 5,580,737 which describes highly specific nucleic acid ligands containing one or more nucleotides modified with 2'-amino (2'-NH$_2$), 2'-fluoro (2'-F), and/or 2'-O-methyl (2'-OMe) substituents.

Modifications of the nucleic acid ligands contemplated in this invention include, but are not limited to, those which provide other chemical groups that incorporate additional charge, polarizability, hydrophobicity, hydrogen bonding, electrostatic interaction, and fluxionality to the nucleic acid ligand bases or to the nucleic acid ligand as a whole. Modifications to generate oligonucleotide populations which are resistant to nucleases can also include one or more substitute internucleotide linkages, altered sugars, altered bases, or combinations thereof. Such modifications include, but are not limited to, 2'-position sugar modifications, 5-position pyrimidine modifications, 8-position purine modifications, modifications at exocyclic amines, substitution of 4-thiouridine, substitution of 5-bromo or 5-iodo-uracil; backbone modifications, phosphorothioate or allyl phosphate modifications, methylations, and unusual base-pairing combinations such as the isobases isocytidine and isoguanosine. Modifications can also include 3' and 5' modifications such as capping.

In one embodiment, oligonucleotides are provided in which the P(O)O group is replaced by P(O)S ("thioate"), P(S)S ("dithioate"), P(O)NR$_2$ ("amidate"), P(O)R, P(O)OR', CO or CH$_2$ ("formacetal") or 3'-amine (—NH—CH$_2$—CH$_2$—), wherein each R or R' is independently H or substituted or unsubstituted alkyl. Linkage groups can be attached to adjacent nucleotides through an —O—, —N—, or —S— linkage. Not all linkages in the oligonucleotide are required to be identical. As used herein, the term phosphorothioate encompasses one or more non-bridging oxygen atoms in a phosphodiester bond replaced by one or more sulfur atoms.

In further embodiments, the oligonucleotides comprise modified sugar groups, for example, one or more of the hydroxyl groups is replaced with halogen, aliphatic groups, or functionalized as ethers or amines. In one embodiment, the 2'-position of the furanose residue is substituted by any of an O-methyl, O-alkyl, O-allyl, S-alkyl, S-allyl, or halo group. Methods of synthesis of 2'-modified sugars are described, e.g., in Sproat, et al., Nucl. Acid Res. 19:733-738 (1991); Cotten, et al., Nucl. Acid Res. 19:2629-2635 (1991); and Hobbs, et al., Biochemistry 12:5138-5145 (1973). Other modifications are known to one of ordinary skill in the art. Such modifications may be pre-SELEX process modifications or post-SELEX process modifications (modification of previously identified unmodified ligands) or may be made by incorporation into the SELEX process.

Pre-SELEX process modifications or those made by incorporation into the SELEX process yield nucleic acid ligands with both specificity for their SELEX target and improved stability, e.g., in vivo stability. Post-SELEX process modifications made to nucleic acid ligands may result in improved stability, e.g., in vivo stability without adversely affecting the binding capacity of the nucleic acid ligand.

The SELEX method encompasses combining selected oligonucleotides with other selected oligonucleotides and non-oligonucleotide functional units as described in U.S. Pat. Nos. 5,637,459 and 5,683,867. The SELEX method further encompasses combining selected nucleic acid ligands with lipophilic or non-immunogenic high molecular weight compounds in a diagnostic or therapeutic complex, as described, e.g., in U.S. Pat. Nos. 6,011,020, 6,051,698, and PCT Publication No. WO 98/18480. These patents and applications teach the combination of a broad array of shapes and other properties, with the efficient amplification and replication properties of oligonucleotides, and with the desirable properties of other molecules.

The identification of nucleic acid ligands to small, flexible peptides via the SELEX method has also been explored. Small peptides have flexible structures and usually exist in solution in an equilibrium of multiple conformers, and thus it was initially thought that binding affinities may be limited by the conformational entropy lost upon binding a flexible peptide. However, the feasibility of identifying nucleic acid ligands to small peptides in solution was demonstrated in U.S. Pat. No. 5,648,214. In this patent, high affinity RNA nucleic acid ligands to substance P, an 11 amino acid peptide, were identified.

The aptamers with specificity and binding affinity to the target(s) of the present invention can be selected by the SELEX N process as described herein. As part of the SELEX process, the sequences selected to bind to the target are then optionally minimized to determine the minimal sequence having the desired binding affinity. The selected sequences and/or the minimized sequences are optionally optimized by performing random or directed mutagenesis of the sequence to increase binding affinity or alternatively to determine which positions in the sequence are essential for binding activity. Additionally, selections can be performed with sequences incorporating modified nucleotides to stabilize the aptamer molecules against degradation in vivo.

2' Modified SELEX

For an aptamer to be suitable for use as a therapeutic, it is preferably inexpensive to synthesize, and safe and stable in vivo. Wild-type RNA and DNA aptamers are typically not stable is vivo because of their susceptibility to degradation by nucleases. Resistance to nuclease degradation can be greatly increased by the incorporation of modifying groups at the 2'-position.

Fluoro and amino groups have been successfully incorporated into oligonucleotide pools from which aptamers have been subsequently selected. However, these modifications greatly increase the cost of synthesis of the resultant aptamer, and may introduce safety concerns in some cases because of the possibility that the modified nucleotides could be recycled into host DNA by degradation of the modified oligonucleotides and subsequent use of the nucleotides as substrates for DNA synthesis.

Aptamers that contain 2'-O-methyl ("2'-OMe") nucleotides, as provided herein, may overcome one or more potential drawbacks. Oligonucleotides containing 2'-OMe nucleotides are nuclease-resistant and inexpensive to synthesize. Although 2'-OMe nucleotides are ubiquitous in biological systems, natural polymerases do not accept 2'-OMe NTPs as substrates under physiological conditions, thus there are no safety concerns over the recycling of 2'-OMe nucleotides into host DNA. The SELEX method used to generate 2'-modified aptamers is described, e.g., in U.S. Provisional Patent Application Ser. No. 60/430,761, filed Dec. 3, 2002, U.S. Provisional Patent Application Ser. No. 60/487,474, filed Jul. 15, 2003, U.S. Provisional Patent Application Ser. No. 60/517,039, filed Nov. 4, 2003, U.S. patent application Ser. No. 10/729,581, filed Dec. 3, 2003, and U.S. patent application Ser. No. 10/873,856, filed Jun. 21, 2004, entitled "Method for in vitro Selection of 2'-O-methyl substituted Nucleic Acids", each of which is herein incorporated by reference in its entirety.

Methods

Biomarker Detection and Diagnostics

The aptamers of the invention can be used in various methods to assess presence or level of biomarkers in a biological sample, e.g., biological entities of interest such as proteins, nucleic acids, or microvesicles. The aptamer functions as a binding agent to assess presence or level of the cognate target molecule. Therefore, in various embodiments of the invention directed to diagnostics, prognostics or theranostics, one or more aptamers of the invention are configured in a ligand-target based assay, where one or more aptamer of the invention is contacted with a selected biological sample, where the or more aptamer associates with or binds to its target molecules. Aptamers of the invention are used to identify candidate biosignatures based on the biological samples assessed and biomarkers detected. In further embodiments, aptamers may themselves provide a biosignature for a particular condition or disease. A biosignature refers to a biomarker profile of a biological sample comprising a presence, level or other characteristic that can be assessed (including without limitation a sequence, mutation, rearrangement, translocation, deletion, epigenetic modification, methylation, post-translational modification, allele, activity, complex partners, stability, half life, and the like) of one or more biomarker of interest. Biosignatures can be used to evaluate diagnostic and/or prognostic criteria such as presence of disease, disease staging, disease monitoring, disease stratification, or surveillance for detection, metastasis or recurrence or progression of disease. For example, methods of the invention using aptamers against microvesicle surface antigen are useful for correlating a biosignature comprising microvesicle antigens to a selected condition or disease. A biosignature can also be used clinically in making decisions concerning treatment modalities including therapeutic intervention. A biosignature can further be used clinically to make treatment decisions, including whether to perform surgery or what treatment standards should be used along with surgery (e.g., either pre-surgery or post-surgery). As an illustrative example, a biosignature of circulating biomarkers that indicates an aggressive form of cancer may call for a more aggressive surgical procedure and/or more aggressive therapeutic regimen to treat the patient.

A biosignature can be used in any methods disclosed herein, e.g., to assess whether a subject is afflicted with disease, is at risk for developing disease or to assess the stage or progression of the disease. For example, a biosignature can be used to assess whether a subject has prostate cancer, colon cancer, or other cancer as described herein. Furthermore, a biosignature can be used to determine a stage of a disease or condition, such as colon cancer. The biosignature/biomarker profile comprising a microvesicle can include assessment of payload within the microvesicle. For example, one or more aptamer of the invention can be used to capture a microvesicle population, thereby providing readout of microvesicle antigens, and then the payload content within the captured microvesicles can be assessed, thereby providing further biomarker readout of the payload content.

A biosignature for characterizing a phenotype may comprise any number of useful criteria. As described further below, the term "phenotype" as used herein can mean any trait or characteristic that is attributed to a biosignature/biomarker profile. A phenotype can be detected or identified in part or in whole using the compositions and/or methods of the invention. In some embodiments, at least one criterion is used for each biomarker. In some embodiments, at least 1, 2, 3, 4, 5, 6, 7, 8, 9, 10, 15, 20, 30, 40, 50, 60, 70, 80, 90 or at least 100 criteria are used. For example, for the characterizing of a cancer, a number of different criteria can be used when the subject is diagnosed with a cancer: 1) if the amount of microRNA in a sample from a subject is higher than a reference value; 2) if the amount of a microRNA within cell type specific vesicles (i.e. vesicles derived from a specific tissue or organ) is higher than a reference value; or 3) if the amount of microRNA within vesicles with one or more cancer specific biomarkers is higher than a reference value. Similar rules can apply if the amount of microRNA is less than or the same as the reference. The method can further include a quality control measure, such that the results are provided for the subject if the samples meet the quality control measure. In some embodiments, if the criteria are met but the quality control is questionable, the subject is reassessed.

Theranostics

A biosignature can be used in therapy related diagnostics to provide tests useful to diagnose a disease or choose the correct treatment regimen, such as provide a theranosis. Theranostics includes diagnostic testing that provides the ability to affect therapy or treatment of a diseased state. Theranostics testing provides a theranosis in a similar manner that diagnostics or prognostic testing provides a diagnosis or prognosis, respectively. As used herein, theranostics encompasses any desired form of therapy related testing, including predictive medicine, personalized medicine, integrated medicine, pharmacodiagnostics and Dx/Rx partnering. Therapy related tests can be used to predict and assess drug response in individual subjects, i.e., to provide personalized medicine. Predicting a drug response can be determining whether a subject is a likely responder or a likely non-responder to a candidate therapeutic agent, e.g., before the subject has been exposed or otherwise treated with the treatment. Assessing a drug response can be monitoring a response to a drug, e.g., monitoring the subject's improvement or lack thereof over a time course after initiating the treatment. Therapy related tests are useful to select a subject for treatment who is particularly likely to benefit from the treatment or to provide an early and objective indication of treatment efficacy in an individual subject. Thus, a biosignature as disclosed herein may indicate that treatment should be altered to select a more promising treatment, thereby avoiding the great expense of delaying beneficial treatment and avoiding the financial and morbidity costs of administering an ineffective drug(s).

The compositions and methods of the invention can be used to identify or detect a biosignature associated with a variety of diseases and disorders, which include, but are not limited to cardiovascular disease, cancer, infectious diseases, sepsis, neurological diseases, central nervous system related diseases, endovascular related diseases, and autoimmune related diseases. Therapy related diagnostics (i.e., theranostics) are also useful in clinical diagnosis and management of many such diseases and disorders. Therapy related diagnostics also aid in the prediction of drug toxicity, drug resistance or drug response. Therapy related tests may be developed in any suitable diagnostic testing format, which include, but are not limited to, e.g., immunohistochemical tests, clinical chemistry, immunoassay, cell-based technologies, nucleic acid tests or body imaging methods. Therapy related tests can further include but are not limited to, testing that aids in the determination of therapy, testing that monitors for therapeutic toxicity, or response to therapy testing. Thus, a biosignature can be used to predict or monitor a subject's response to a treatment. A biosignature can be determined at different time points for a subject after initiating, removing, or altering a particular treatment.

In some embodiments, the compositions and methods of the invention provide for a determination or prediction as to whether a subject is responding to a treatment is made based on a change in the amount of one or more components of a biosignature (i.e., the microRNA, vesicles and/or biomarkers of interest), an amount of one or more components of a particular biosignature, or the biosignature detected for the components. In another embodiment, a subject's condition is monitored by determining a biosignature at different time points. The progression, regression, or recurrence of a condition is determined. Response to therapy can also be measured over a time course. Thus, the invention provides a method of monitoring a status of a disease or other medical condition in a subject, comprising isolating or detecting a biosignature from a biological sample from the subject, detecting the overall amount of the components of a particular biosignature, or detecting the biosignature of one or more components (such as the presence, absence, or expression level of a biomarker). The biosignatures are used to monitor the status of the disease or condition.

One or more novel biosignatures of a vesicle can also be identified. For example, one or more vesicles can be isolated from a subject that responds to a drug treatment or treatment regimen and compared to a reference, such as another subject that does not respond to the drug treatment or treatment regimen. Differences between the biosignatures can be determined and used to identify other subjects as responders or non-responders to a particular drug or treatment regimen.

In some embodiments, a biosignature is used to determine whether a particular disease or condition is resistant to a drug, in which case a physician need not waste valuable time with such drug treatment. To obtain early validation of a drug choice or treatment regimen, a biosignature is determined for a sample obtained from a subject. The biosignature is used to assess whether the particular subject's disease has the biomarker associated with drug resistance. Such a determination enables doctors to devote critical time as well as the patient's financial resources to effective treatments.

Biosignatures can be used in the theranosis of a cancer, such as identifying whether a subject suffering from cancer is a likely responder or non-responder to a particular cancer treatment. The subject methods can be used to theranose cancers including those listed herein, e.g., in the "Phenotypes" section below. These include without limitation lung cancer, non-small cell lung cancer small cell lung cancer (including small cell carcinoma (oat cell cancer), mixed small cell/large cell carcinoma, and combined small cell carcinoma), colon cancer, breast cancer, prostate cancer, liver cancer, pancreatic cancer, brain cancer, kidney cancer, ovarian cancer, stomach cancer, melanoma, bone cancer, gastric cancer, breast cancer, glioma, glioblastoma, hepatocellular carcinoma, papillary renal carcinoma, head and neck squamous cell carcinoma, leukemia, lymphoma, myeloma, or other solid tumors.

A biosignature of circulating biomarkers, including markers associated with a component present in a biological sample (e.g., cell, cell-fragment, cell-derived extracellular vesicle), in a sample from a subject suffering from a cancer can be used select a candidate treatment for the subject. The biosignature can be determined according to the methods of the invention presented herein. In some embodiments, the candidate treatment comprises a standard of care for the cancer. The treatment can be a cancer treatment such as radiation, surgery chemotherapy or a combination thereof. The cancer treatment can be a therapeutic such as anticancer agents and chemotherapeutic regimens. Further drug associations and rules that are used in embodiments of the invention are found in PCT/US2007/69286, filed May 18, 2007; PCT/US2009/60630, filed Oct. 14, 2009; PCT/2010/000407, filed Feb. 11, 2010; PCT/US12/41393, filed Jun. 7, 2012; PCT/US2013/073184, filed Dec. 4, 2013; PCT/US2010/54366, filed Oct. 27, 2010; PCT/US11/67527, filed Dec. 28, 2011; PCT/US15/13618, filed Jan. 29, 2015; and PCT/US16/20657, filed Mar. 3, 2016.

Biomarker Detection

The compositions and methods of the invention can be used to assess any useful biomarkers in a biological sample for characterizing a phenotype associated with the sample. Such biomarkers include all sorts of biological entities such as proteins, nucleic acids, lipids, carbohydrates, complexes of any thereof, and microvesicles. Various molecules associated with a microvesicle surface or enclosed within the microvesicle (referred to herein as "payload") can serve as biomarkers. The microvesicles themselves can also be used as biomarkers.

The aptamers of the invention can be used to assess levels or presence of a microvesicle population. See, e.g., FIGS. 19B-C. The aptamers of the invention can also be used to assess levels or presence of their specific target molecule. See, e.g., FIG. 19A. In addition, aptamers of the invention are used to capture or isolated a component present in a biological sample that has the aptamer's target molecule present. For example, if a given microvesicle surface antigen is present on a cell, cell fragment or cell-derived extracellular vesicle. A binding agent to the biomarker, including without limitation an aptamer provided by the invention, may be used to capture or isolate the cell, cell fragment or cell-derived extracellular vesicles. See, e.g., FIGS. 2A-B, 19A. Such captured or isolated entities may be further characterized to assess additional surface antigens or internal "payload" molecules present (i.e., nucleic acid molecules, lipids, sugars, polypeptides or functional fragments thereof, or anything else present in the cellular milieu that may be used as a biomarker), where one or more biomarkers provide a biosignature to assess a desired phenotype, such a s disease or condition. See, e.g., FIG. 2F. Therefore, aptamers of the invention are used not only to assess one or more microvesicle surface antigen of interest but are also used to separate a component present in a biological sample, where the components themselves can be further assessed to identify a candidate biosignature.

The methods of the invention can comprise multiplex analysis of at least 2, 3, 4, 5, 6, 7, 8, 9, 10, 11, 12, 13, 14, 15, 16, 17, 18, 19, 20, 25, 50, 75 or 100 different biomarkers. For example, an assay of a heterogeneous population of vesicles can be performed with a plurality of particles that are differentially labeled. There can be at least 2, 3, 4, 5, 6, 7, 8, 9, 10, 11, 12, 13, 14, 15, 16, 17, 18, 19, 20, 25, 50, 75 or 100 differentially labeled particles. The particles may be externally labeled, such as with a tag, or they may be intrinsically labeled. Each differentially labeled particle can be coupled to a capture agent, such as a binding agent, for a vesicle, resulting in capture of a vesicle. The multiple capture agents can be selected to characterize a phenotype of interest, including capture agents against general vesicle biomarkers, cell-of-origin specific biomarkers, and disease biomarkers. One or more biomarkers of the captured vesicle can then be detected by a plurality of binding agents. The binding agent can be directly labeled to facilitate detection. Alternatively, the binding agent is labeled by a secondary agent. For example, the binding agent may be an antibody for a biomarker on the vesicle, wherein the binding agent is linked to biotin. A secondary agent comprises streptavidin linked to a reporter and can be added to detect the biomarker. In some embodiments, the captured vesicle is assayed for at least 2, 3, 4, 5, 6, 7, 8, 9, 10, 11, 12, 13, 14, 15, 16, 17, 18, 19, 20, 25, 50, 75 or 100 different biomarkers. For example, multiple detectors, i.e., detection of multiple biomarkers of a captured vesicle or population of vesicles, can increase the signal obtained, permitted increased sensitivity, specificity, or both, and the use of smaller amounts of samples. Detection can be with more than one biomarker, including without limitation more than one vesicle marker such as in any of Tables 3-4, and Tables 18-25.

Figure 2A:
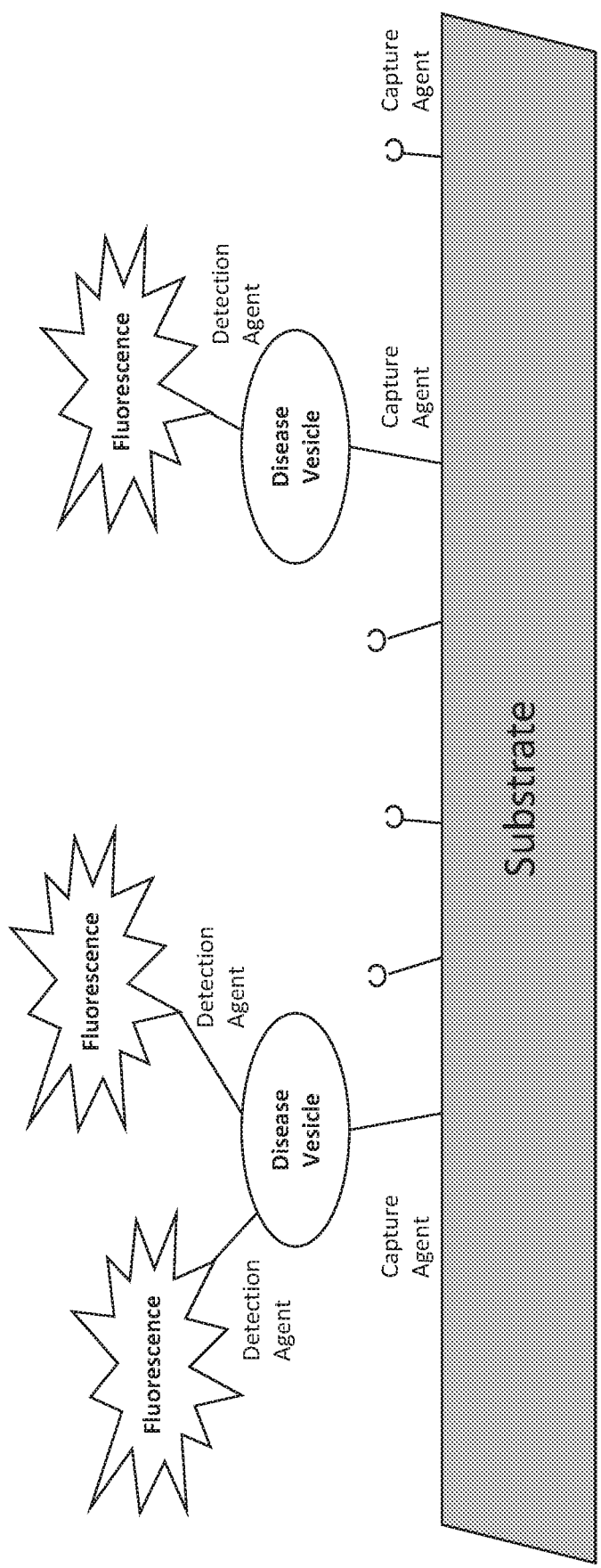
Figure 2B:
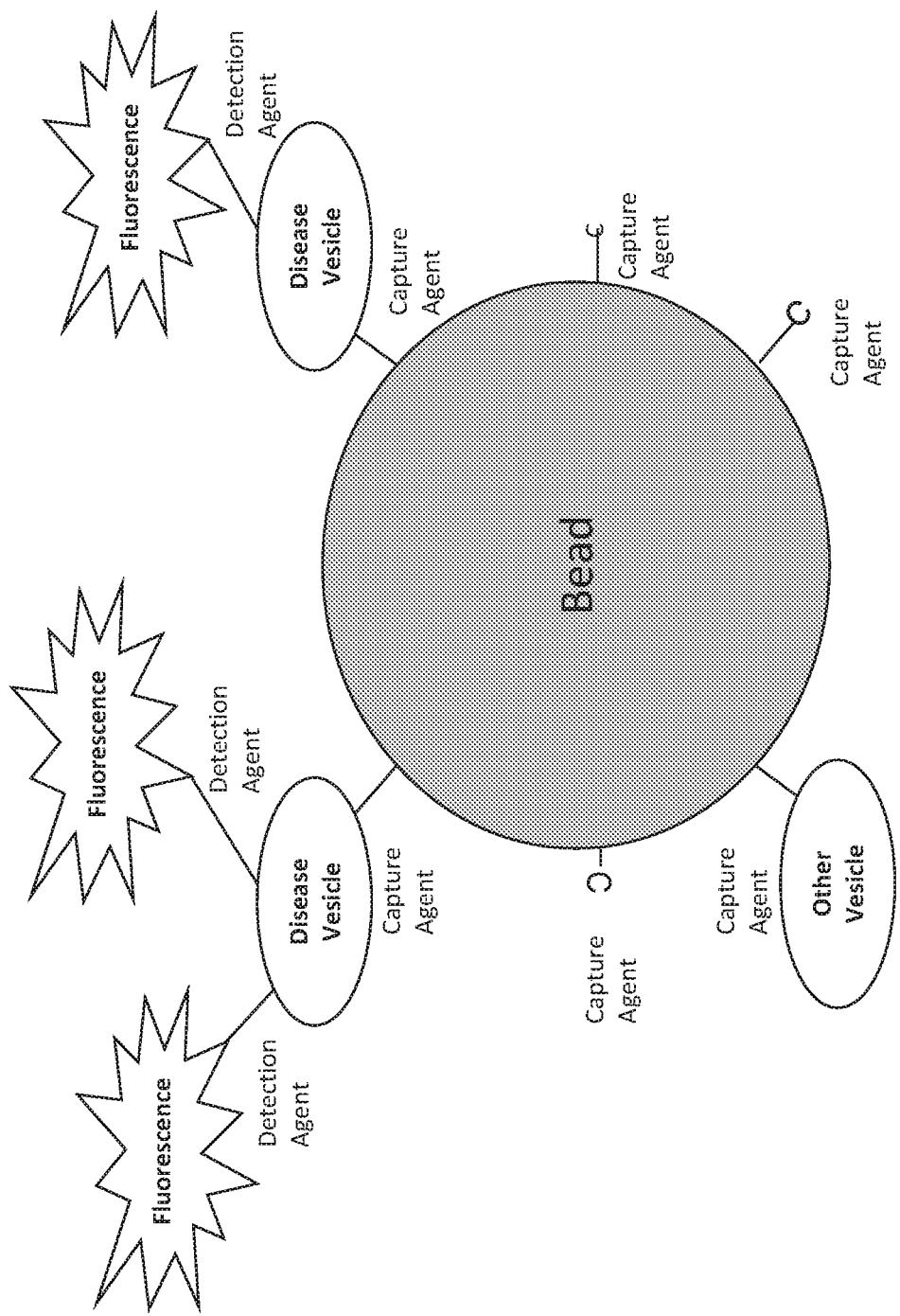

An immunoassay based method (e.g., sandwich assay) can be used to detect a biomarker of a vesicle. An example includes ELISA. A binding agent can be bound to a well. For example, a binding agent such as an aptamer or antibody to an antigen of a vesicle can be attached to a well. A biomarker on the captured vesicle can be detected based on the methods described herein. FIG. 2A shows an illustrative schematic for a sandwich-type of immunoassay. The capture agent can be against a vesicle antigen of interest, e.g., a general vesicle biomarker, a cell-of-origin marker, or a disease marker. In the figure, the captured vesicles are detected using fluorescently labeled binding agent (detection agent) against vesicle antigens of interest. Multiple capture binding agents can be used, e.g., in distinguishable addresses on an array or different wells of an immunoassay plate. The detection binding agents can be against the same antigen as the capture binding agent, or can be directed against other markers. The capture binding agent can be any useful binding agent, e.g., tethered aptamers, antibodies or lectins, and/or the detector antibodies can be similarly substituted, e.g., with detectable (e.g., labeled) aptamers, antibodies, lectins or other binding proteins or entities. In an embodiment, one or more capture agents to a general vesicle biomarker, a cell-of-origin marker, and/or a disease marker are used along with detection agents against general vesicle biomarker, such as tetraspanin molecules including without limitation one or more of CD9, CD63 and CD81, or other markers in Table 3 herein. Examples of microvesicle surface antigens are disclosed herein, e.g. in Tables 3-4 and 18-25, or are known in the art, and examples useful in methods and compositions of the invention are disclosed of International Patent Application Nos. PCT/US2009/62880, filed Oct. 30, 2009; PCT/US2009/006095, filed Nov. 12, 2009; PCT/US2011/26750, filed Mar. 1, 2011; PCT/US2011/031479, filed Apr. 6, 2011; PCT/US11/48327, filed Aug. 18, 2011; PCT/US2008/71235, filed Jul. 25, 2008; PCT/US10/58461, filed Nov. 30, 2010; PCT/US2011/21160, filed Jan. 13, 2011; PCT/US2013/030302, filed Mar. 11, 2013; PCT/US12/25741, filed Feb.

17, 2012; PCT/2008/76109, filed Sep. 12, 2008; PCT/US12/42519, filed Jun. 14, 2012; PCT/US12/50030, filed Aug. 8, 2012; PCT/US12/49615, filed Aug. 3, 2012; PCT/US12/41387, filed Jun. 7, 2012; PCT/US2013/072019, filed Nov. 26, 2013; PCT/US2014/039858, filed May 28, 2013; PCT/IB2013/003092, filed Oct. 23, 2013; PCT/US13/76611, filed Dec. 19, 2013; PCT/US14/53306, filed Aug. 28, 2014; and PCT/US15/62184, filed Nov. 23, 2015; each of which applications is incorporated herein by reference in its entirety.

Figure 2D:
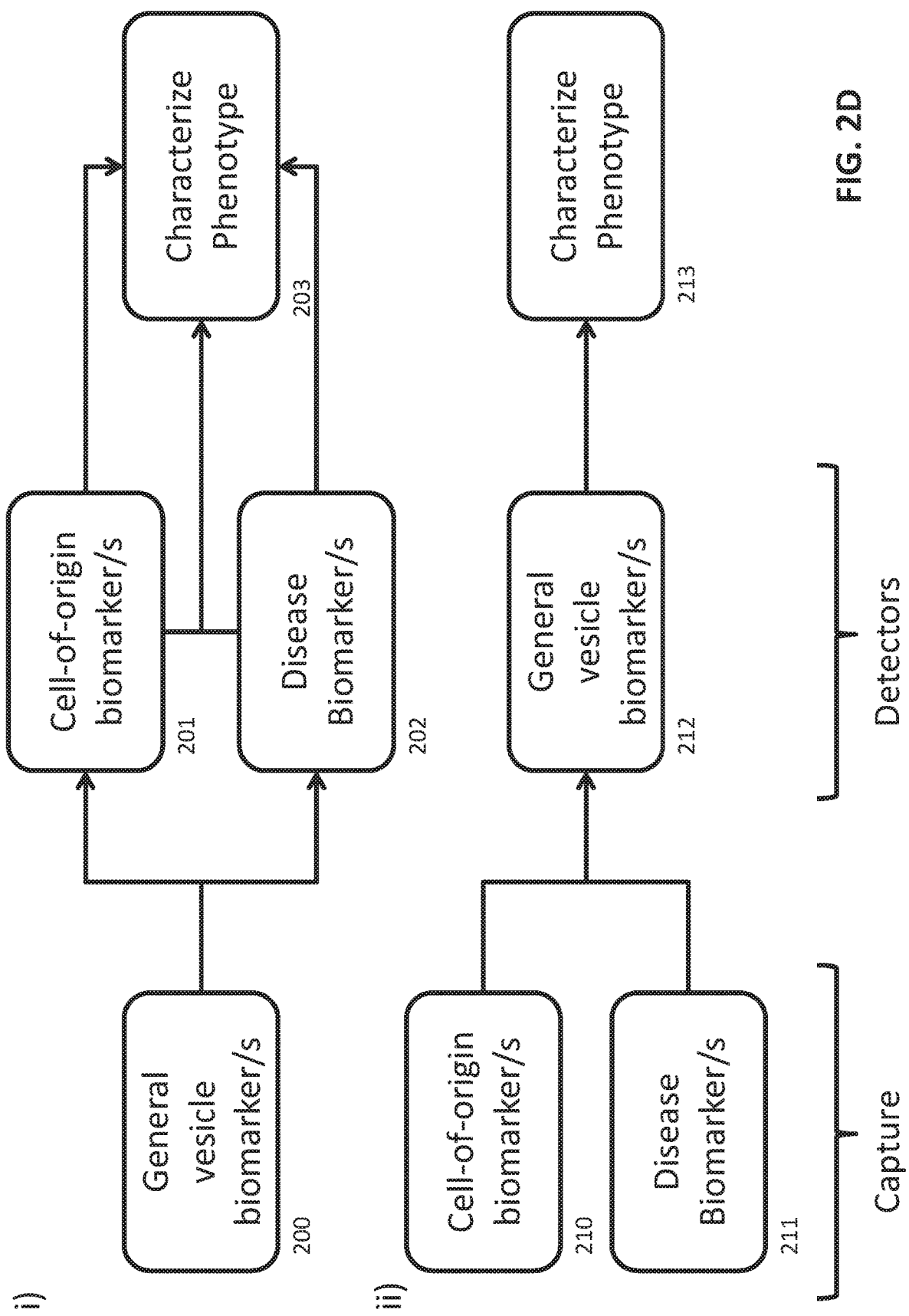

FIG. 2D presents an illustrative schematic for analyzing vesicles according to the methods of the invention. Capture agents are used to capture vesicles, detectors are used to detect the captured vesicles, and the level or presence of the captured and detected microvesicles is used to characterize a phenotype. Capture agents, detectors and characterizing phenotypes can be any of those described herein. For example, capture agents include antibodies or aptamers tethered to a substrate that recognize a vesicle antigen of interest, detectors include labeled antibodies or aptamers to a vesicle antigen of interest, and characterizing a phenotype includes a diagnosis, prognosis, or theranosis of a disease. In the scheme shown in FIG. 2D i), a population of vesicles is captured with one or more capture agents against general vesicle biomarkers (200). The captured vesicles are then labeled with detectors against cell-of-origin biomarkers (201) and/or disease specific biomarkers (202). If only cell-of-origin detectors are used (201), the biosignature used to characterize the phenotype (203) can include the general vesicle markers (200) and the cell-of-origin biomarkers (201). If only disease detectors are used (202), the biosignature used to characterize the phenotype (203) can include the general vesicle markers (200) and the disease biomarkers (202). Alternately, detectors are used to detect both cell-of-origin biomarkers (201) and disease specific biomarkers (202). In this case, the biosignature used to characterize the phenotype (203) can include the general vesicle markers (200), the cell-of-origin biomarkers (201) and the disease biomarkers (202). The biomarkers combinations are selected to characterize the phenotype of interest and can be selected from the biomarkers and phenotypes described herein, e.g., in Tables 1, 3-4 and 18-25.

In the scheme shown in FIG. 2D ii), a population of vesicles is captured with one or more capture agents against cell-of-origin biomarkers (210) and/or disease biomarkers (211). The captured vesicles are then detected using detectors against general vesicle biomarkers (212). If only cell-of-origin capture agents are used (210), the biosignature used to characterize the phenotype (213) can include the cell-of-origin biomarkers (210) and the general vesicle markers (212). If only disease biomarker capture agents are used (211), the biosignature used to characterize the phenotype (213) can include the disease biomarkers (211) and the general vesicle biomarkers (212). Alternately, capture agents to one or more cell-of-origin biomarkers (210) and one or more disease specific biomarkers (211) are used to capture vesicles. In this case, the biosignature used to characterize the phenotype (213) can include the cell-of-origin biomarkers (210), the disease biomarkers (211), and the general vesicle markers (213). The biomarkers combinations are selected to characterize the phenotype of interest and can be selected from the biomarkers and phenotypes described herein.

Figure 2E:
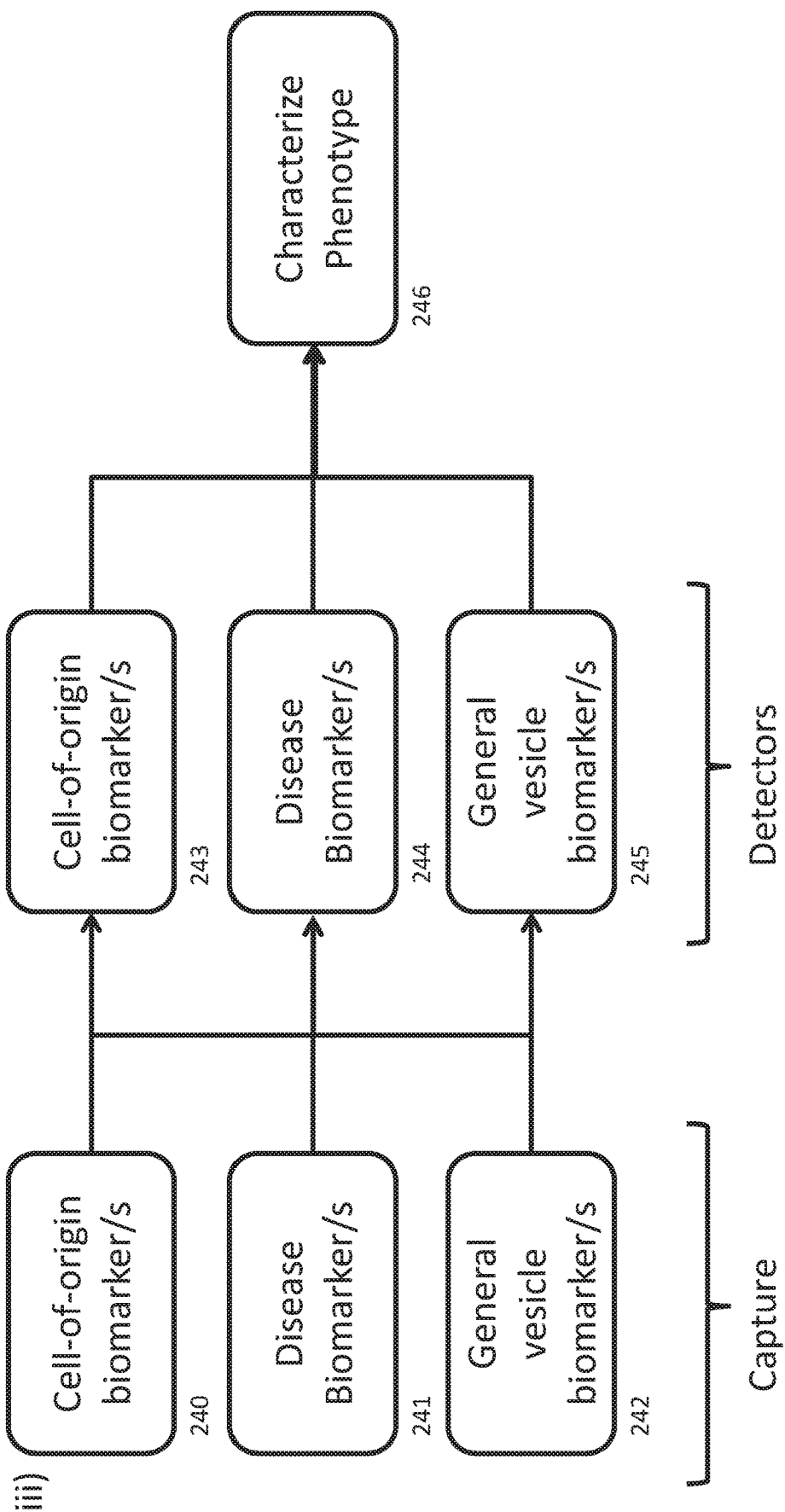
Figure 2F:
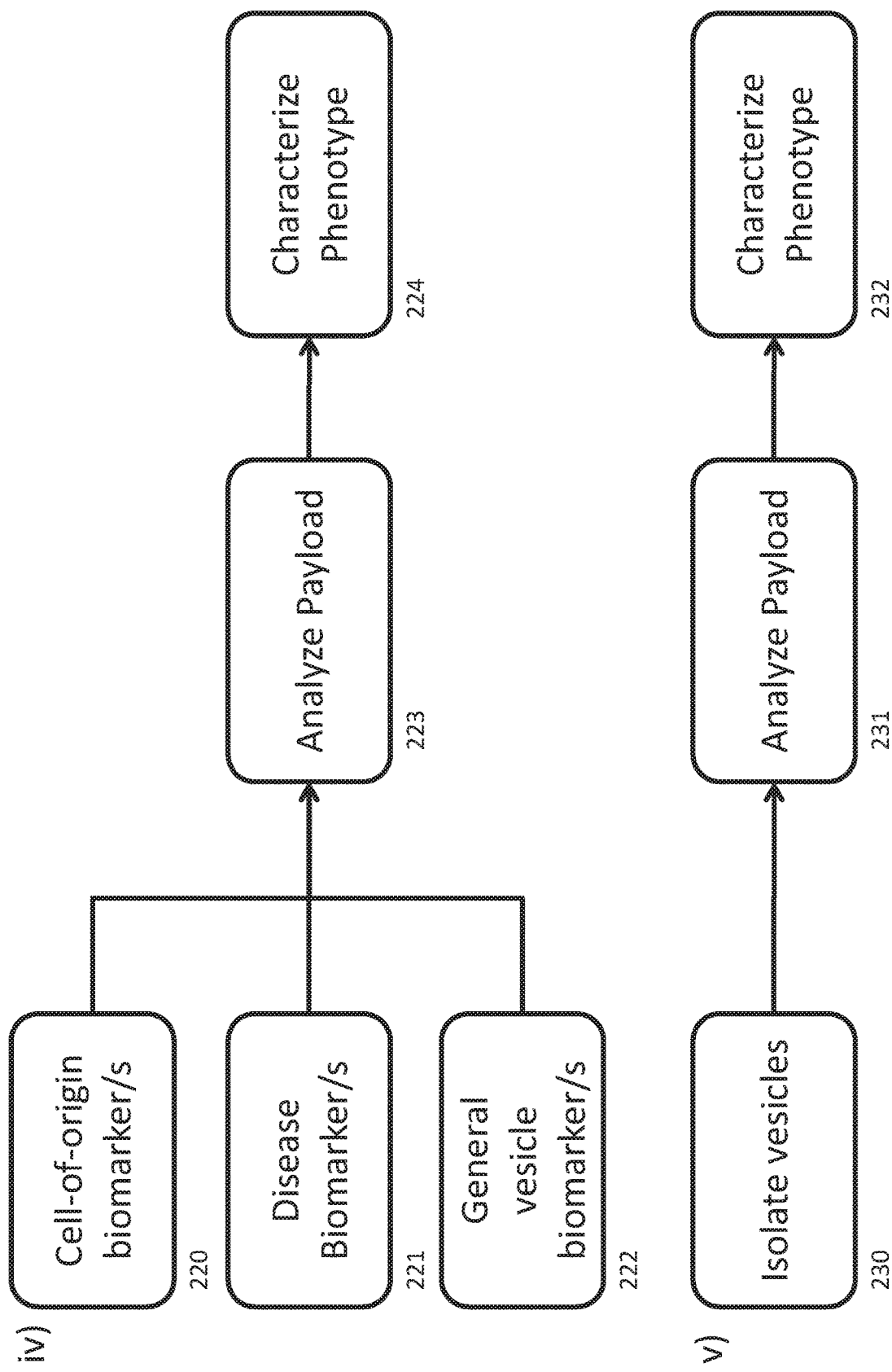

The methods of the invention comprise capture and detection of microvesicles of interest using any combination of useful biomarkers. For example, a microvesicle population can be captured using one or more binding agent to any desired combination of cell of origin, disease specific, or general vesicle markers. The captured microvesicles can then be detected using one or more binding agent to any desired combination of cell of origin, disease specific, or general vesicle markers. FIG. 2E represents a flow diagram of such configurations. Any one or more of a cell-of-origin biomarker (240), disease biomarkers (241), and general vesicle biomarker (242) is used to capture a microvesicle population. Thereafter, any one or more of a cell-of-origin biomarker (243), disease biomarkers (244), and general vesicle biomarker (245) is used to detect the captured microvesicle population. The biosignature of captured and detected microvesicles is then used to characterize a phenotype. The biomarkers combinations are selected to characterize the phenotype of interest and can be selected from the biomarkers and phenotypes described herein.

A microvesicle payload molecule can be assessed as a member of a biosignature panel. A payload molecule comprises any of the biological entities contained within a cell, cell fragment or vesicle membrane. These entities include without limitation nucleic acids, e.g., mRNA, microRNA, or DNA fragments; protein, e.g., soluble and membrane associated proteins; carbohydrates; lipids; metabolites; and various small molecules, e.g., hormones. The payload can be part of the cellular milieu that is encapsulated as a vesicle is formed in the cellular environment. In some embodiments of the invention, the payload is analyzed in addition to detecting vesicle surface antigens. Specific populations of vesicles can be captured as described above then the payload in the captured vesicles can be used to characterize a phenotype. For example, vesicles captured on a substrate can be further isolated to assess the payload therein. Alternately, the vesicles in a sample are detected and sorted without capture. The vesicles so detected can be further isolated to assess the payload therein. In an embodiment, vesicle populations are sorted by flow cytometry and the payload in the sorted vesicles is analyzed. In the scheme shown in FIG. 2F iv), a population of vesicles is captured and/or detected (220) using one or more of cell-of-origin biomarkers (220), disease biomarkers (221), and/or general vesicle markers (222). The payload of the isolated vesicles is assessed (223). A biosignature detected within the payload can be used to characterize a phenotype (224). In a non-limiting example, a vesicle population can be analyzed in a plasma sample from a patient using antibodies against one or more vesicle antigens of interest. The antibodies can be capture antibodies which are tethered to a substrate to isolate a desired vesicle population. Alternately, the antibodies can be directly labeled and the labeled vesicles isolated by sorting with flow cytometry. The presence or level of microRNA or mRNA extracted from the isolated vesicle population can be used to detect a biosignature. The biosignature is then used to diagnose, prognose or theranose the patient.

In other embodiments, vesicle or cellular payload is analyzed in a population (e.g., cells or vesicles) without first capturing or detected subpopulations of vesicles. For example, a cellular or extracellular vesicle population can be generally isolated from a sample using centrifugation, filtration, chromatography, or other techniques as described herein and known in the art. The payload of such sample components can be analyzed thereafter to detect a biosignature and characterize a phenotype. In the scheme shown in FIG. 2F v), a population of vesicles is isolated (230) and the payload of the isolated vesicles is assessed (231). A biosignature detected within the payload can be used to characterize a phenotype (232). In a non-limiting example, a vesicle population is isolated from a plasma sample from a patient using size exclusion and membrane filtration. The presence or level of microRNA or mRNA extracted from the vesicle population is used to detect a biosignature. The biosignature is then used to diagnose, prognose or theranose the patient.

The biomarkers used to detect a vesicle population can be selected to detect a microvesicle population of interest, e.g., a population of vesicles that provides a diagnosis, prognosis or theranosis of a selected condition or disease, including but not limited to a cancer, a premalignant condition, an inflammatory disease, an immune disease, an autoimmune disease or disorder, a cardiovascular disease or disorder, neurological disease or disorder, infectious disease or pain. See Section "Phenotypes" herein for more detail. In an embodiment, the biomarkers are selected from the group consisting of EpCam (epithelial cell adhesion molecule), CD9 (tetraspanin CD9 molecule), PCSA (prostate cell specific antigen, see Rokhlin et al., 5E10: a prostate-specific surface-reactive monoclonal antibody. Cancer Lett. 1998 131:129-36), CD63 (tetraspanin CD63 molecule), CD81 (tetraspanin CD81 molecule), PSMA (FOLH1, folate hydrolase (prostate-specific membrane antigen) 1), B7H3 (CD276 molecule), PSCA (prostate stem cell antigen), ICAM (intercellular adhesion molecule), STEAP (STEAP1, six transmembrane epithelial antigen of the prostate 1), KLK2 (kallikrein-related peptidase 2), SSx2 (synovial sarcoma, X breakpoint 2), SSx4 (synovial sarcoma, X breakpoint 4), PBP (prostatic binding protein), SPDEF (SAM pointed domain containing ets transcription factor), EGFR (epidermal growth factor receptor), and a combination thereof. One or more of these markers can provide a biosignature for a specific condition, such as to detect a cancer, including without limitation a carcinoma, a prostate cancer, a breast cancer, a lung cancer, a colorectal cancer, an ovarian cancer, melanoma, a brain cancer, or other type of cancer as disclosed herein. In an embodiment, a binding agent to one or more of these markers is used to capture a microvesicle population, and an aptamer of the invention is used to assist in detection of the capture vesicles as described herein. In other embodiments, an aptamer of the invention is used to capture a microvesicle population, and a binding agent to one or more of these markers is used to assist in detection of the capture vesicles as described herein. The binding agents can be any useful binding agent as disclosed herein or known in the art, e.g., antibodies or aptamers.

The methods of characterizing a phenotype can employ a combination of techniques to assess a component or population of components present in a biological sample of interest. For example, an aptamer of the invention can be used to assess a single cell, or a single extracellular vesicle or a population of cells or population of vesicles. A sample may be split into various aliquots, where each is analyzed separately. For example, protein content of one or more aliquot is determined and microRNA content of one or more other aliquot is determined. The protein content and microRNA content can be combined to characterize a phenotype. In another embodiment, a component present in a biological sample of interest is isolated and the payload therein is assessed (e.g., capture a population of subpopulation of vesicles using an aptamer of the invention and further assess nucleic acid or proteins present in the isolated vesicles).

In one embodiment, a population of vesicles with a given surface marker can be isolated by using a binding agent to a microvesicle surface marker. See, e.g., FIGS. 2A, 2B, 21A. The binding agent can be an aptamer that was identified to target the microvesicle surface marker using to the methods of the invention. The isolated vesicles is assessed for additional biomarkers such as surface content or payload, which can be contemporaneous to detection of the aptamer-specific target or the assessment of additional biomarkers can be before or subsequent to aptamer-specific target detection.

A biosignature can be detected qualitatively or quantitatively by detecting a presence, level or concentration of a circulating biomarker, e.g., a microRNA, protein, vesicle or other biomarker, as disclosed herein. These biosignature components can be detected using a number of techniques known to those of skill in the art. For example, a biomarker can be detected by microarray analysis, polymerase chain reaction (PCR) (including PCR-based methods such as real time polymerase chain reaction (RT-PCR), quantitative real time polymerase chain reaction (Q-PCR/qPCR) and the like), hybridization with allele-specific probes, enzymatic mutation detection, ligation chain reaction (LCR), oligonucleotide ligation assay (OLA), flow-cytometric heteroduplex analysis, chemical cleavage of mismatches, mass spectrometry, nucleic acid sequencing, single strand conformation polymorphism (SSCP), denaturing gradient gel electrophoresis (DGGE), temperature gradient gel electrophoresis (TGGE), restriction fragment polymorphisms, serial analysis of gene expression (SAGE), or combinations thereof. A biomarker, such as a nucleic acid, can be amplified prior to detection. A biomarker can also be detected by immunoassay, immunoblot, immunoprecipitation, enzyme-linked immunosorbent assay (ELISA; EIA), radioimmunoassay (RIA), flow cytometry, or electron microscopy (EM).

Biosignatures can be detected using aptamers of the invention that function as either as capture agents and detection agents, as described herein. A capture agent can comprise an antibody, aptamer or other entity which recognizes a biomarker and can be used for capturing the biomarker. Biomarkers that can be captured include circulating biomarkers, e.g., a protein, nucleic acid, lipid or biological complex in solution in a bodily fluid. Similarly, the capture agent can be used for capturing a vesicle. A detection agent can comprise an antibody or other entity which recognizes a biomarker and can be used for detecting the biomarker vesicle, or which recognizes a vesicle and is useful for detecting a vesicle. In some embodiments, the detection agent is labeled and the label is detected, thereby detecting the biomarker or vesicle. The detection agent can be a binding agent, e.g., an antibody or aptamer. In other embodiments, the detection agent comprises a small molecule such as a membrane protein labeling agent. See, e.g., the membrane protein labeling agents disclosed in Alroy et al., US. Patent Publication US 2005/0158708. In an embodiment, vesicles are isolated or captured as described herein, and one or more membrane protein labeling agent is used to detect the vesicles. In many cases, the antigen or other vesicle-moiety that is recognized by the capture and detection agents are interchangeable.

In a non-limiting embodiment, a vesicle having a cell-of-origin specific antigen on its surface and a cancer-specific antigen on its surface, is captured using a binding agent that is specific to a cells-specific antigen, e.g., by tethering the capture antibody or aptamer to a substrate, and then the vesicle is detected using a binding agent to a disease-specific antigen, e.g., by labeling the binding agent used for detection with a fluorescent dye and detecting the fluorescent radiation emitted by the dye.

It will be apparent to one of skill in the art that where the target molecule for a binding agent (such as an aptamer of the invention) is informative as to assessing a condition or disease, the same binding agent can be used to both capture a component comprising the target molecule (e.g., microvesicle surface antigen of interest) and also be modified to comprise a detectable label so as to detect the target molecule, e.g., binding agent$_1$-antigen-binding agent$_2$*, wherein the * signifies a detectable label; binding agent$_1$ and binding agent$_2$ may be the same binding agent or a different binding agent (e.g., same aptamer or different aptamer). In addition, binding agent$_1$ and binding agent$_2$ can be selected from wholly different categories of binding agents (e.g., antibody, aptamer, synthetic antibody, peptide-nucleic acid molecule, or any molecule that is configured to specifically bind to or associate with its target molecule). Such binding molecules can be selected solely based on their binding specificity for a target molecule. Examples of additional biomarkers that can be incorporated into the methods and compositions of the invention are known in the art, such as those disclosed in International Patent Publication Nos. WO/2012/174282 (Int'l Appl. PCT/US2012/042519 filed Jun. 14, 2012) and WO/2013/020995 (Int'l Appl. PCT/US2012/050030 filed Aug. 8, 2013). The detectable signal can itself be associated with a nucleic acid molecule that hybridizes with a stretch of nucleic acids present in each oligonucleotide comprising a probing library. The stretch can be the same or different as to one or more oligonucleotides in a library. The detectable signal can comprise fluorescence agents, including color-coded barcodes which are known, such as in U.S. Patent Application Pub. No. 20140371088, 2013017837, and 20120258870.

Techniques of detecting biomarkers or capturing sample components using an aptamer of the invention include the use of a planar substrate such as an array (e.g., biochip or microarray), with molecules immobilized to the substrate as capture agents that facilitate the detection of a particular biosignature. The array can be provided as part of a kit for assaying one or more biomarkers. Additional examples of binding agents described above and useful in the compositions and methods of the invention are disclosed in International Patent Publication No. WO/2011/127219, entitled "Circulating Biomarkers for Disease" and filed Apr. 6, 2011, which application is incorporated by reference in its entirety herein. Aptamers of the invention can be included in an array for detection and diagnosis of diseases including presymptomatic diseases. In some embodiments, an array comprises a custom array comprising biomolecules selected to specifically identify biomarkers of interest. Customized arrays can be modified to detect biomarkers that increase statistical performance, e.g., additional biomolecules that identifies a biosignature which lead to improved cross-validated error rates in multivariate prediction models (e.g., logistic regression, discriminant analysis, or regression tree models). In some embodiments, customized array(s) are constructed to study the biology of a disease, condition or syndrome and profile biosignatures in defined physiological states. Markers for inclusion on the customized array be chosen based upon statistical criteria, e.g., having a desired level of statistical significance in differentiating between phenotypes or physiological states. In some embodiments, standard significance of p-value=0.05 is chosen to exclude or include biomolecules on the microarray. The p-values can be corrected for multiple comparisons. As an illustrative example, nucleic acids extracted from samples from a subject with or without a disease can be hybridized to a high density microarray that binds to thousands of gene sequences. Nucleic acids whose levels are significantly different between the samples with or without the disease can be selected as biomarkers to distinguish samples as having the disease or not. A customized array can be constructed to detect the selected biomarkers. In some embodiments, customized arrays comprise low density microarrays, which refer to arrays with lower number of addressable binding agents, e.g., tens or hundreds instead of thousands. Low density arrays can be formed on a substrate. In some embodiments, customizable low density arrays use PCR amplification in plate wells, e.g., TaqMan® Gene Expression Assays (Applied Biosystems by Life Technologies Corporation, Carlsbad, Calif.).

An aptamer of the invention or other useful binding agent may be linked directly or indirectly to a solid surface or substrate. See, e.g., FIGS. 2A-2B, 9, 21A. A solid surface or substrate can be any physically separable solid to which a binding agent can be directly or indirectly attached including, but not limited to, surfaces provided by microarrays and wells, particles such as beads, columns, optical fibers, wipes, glass and modified or functionalized glass, quartz, mica, diazotized membranes (paper or nylon), polyformaldehyde, cellulose, cellulose acetate, paper, ceramics, metals, metalloids, semiconductive materials, quantum dots, coated beads or particles, other chromatographic materials, magnetic particles; plastics (including acrylics, polystyrene, copolymers of styrene or other materials, polypropylene, polyethylene, polybutylene, polyurethanes, Teflon material, etc.), polysaccharides, nylon or nitrocellulose, resins, silica or silica-based materials including silicon and modified silicon, carbon, metals, inorganic glasses, plastics, ceramics, conducting polymers (including polymers such as polypyrrole and polyindole); micro or nanostructured surfaces such as nucleic acid tiling arrays, nanotube, nanowire, or nanoparticulate decorated surfaces; or porous surfaces or gels such as methacrylates, acrylamides, sugar polymers, cellulose, silicates, or other fibrous or stranded polymers. In addition, as is known the art, the substrate may be coated using passive or chemically-derivatized coatings with any number of materials, including polymers, such as dextrans, acrylamides, gelatins or agarose. Such coatings can facilitate the use of the array with a biological sample.

As provided in the examples, below, an aptamer or other useful binding agent can be conjugated to a detectable entity or label.

Appropriate labels include without limitation a magnetic label, a fluorescent moiety, an enzyme, a chemiluminescent probe, a metal particle, a non-metal colloidal particle, a polymeric dye particle, a pigment molecule, a pigment particle, an electrochemically active species, semiconductor nanocrystal or other nanoparticles including quantum dots or gold particles, fluorophores, quantum dots, or radioactive labels. Protein labels include green fluorescent protein (GFP) and variants thereof (e.g., cyan fluorescent protein and yellow fluorescent protein); and luminescent proteins such as luciferase, as described below. Radioactive labels include without limitation radioisotopes (radionuclides), such as $^3$H, $^{11}$C, $^{14}$C, $^{18}$F, $^{32}$P, $^{35}$S, $^{64}$Cu, $^{68}$Ga, $^{86}$Y, $^{99}$Tc, $^{111}$In, $^{123}$I, $^{124}$I, $^{125}$I, $^{131}$I, $^{133}$Xe, $^{177}$Lu, $^{211}$At or $^{213}$Bi. Fluorescent labels include without limitation a rare earth chelate (e.g., europium chelate), rhodamine; fluorescein types including without limitation FITC, 5-carboxyfluorescein, 6-carboxy fluorescein; a rhodamine type including without limitation TAMRA; dansyl; Lissamine; cyanines; phycoerythrins; Texas Red; Cy3, Cy5, dapoxyl, NBD, Cascade Yellow, dansyl, PyMPO, pyrene, 7-diethylaminocoumarin-3-carboxylic acid and other coumarin derivatives, Marina Blue™, Pacific Blue™, Cascade Blue™, 2-anthracenesulfonyl, PyMPO, 3,4,9,10-perylene-tetracarboxylic acid, 2,7-difluorofluorescein (Oregon Green™ 488-X), 5-carboxyfluorescein, Texas Red™-X, Alexa Fluor 430, 5-carboxytetramethylrhodamine (5-TAMRA), 6-carboxytetramethylrhodamine (6-TAMRA), BODIPY FL, bimane, and Alexa Fluor 350, 405, 488, 500, 514, 532, 546, 555, 568, 594, 610, 633, 647, 660, 680, 700, and 750, and derivatives thereof, among many others. See, e.g., "The Handbook—A Guide to Fluorescent Probes and Labeling Technologies," Tenth Edition, available on the internet at probes (dot) invitrogen (dot) com/handbook. The fluorescent label can be one or more of FAM, dRHO, 5-FAM, 6FAM, dR6G, JOE, HEX, VIC, TET, dTAMRA, TAMRA, NED, dROX, PET, BHQ, Gold540 and LIZ.

Using conventional techniques, an aptamer can be directly or indirectly labeled, e.g., the label is attached to the aptamer through biotin-streptavidin (e.g., synthesize a biotinylated aptamer, which is then capable of binding a streptavidin molecule that is itself conjugated to a detectable label; non-limiting example is streptavidin, phycoerythrin conjugated (SAPE)). Methods for chemical coupling using multiple step procedures include biotinylation, coupling of trinitrophenol (TNP) or digoxigenin using for example succinimide esters of these compounds. Biotinylation can be accomplished by, for example, the use of D-biotinyl-N-hydroxysuccinimide. Succinimide groups react effectively with amino groups at pH values above 7, and preferentially between about pH 8.0 and about pH 8.5. Alternatively, an aptamer is not labeled, but is later contacted with a second antibody that is labeled after the first antibody is bound to an antigen of interest.

Various enzyme-substrate labels may also be used in conjunction with a composition or method of the invention. Such enzyme-substrate labels are available commercially (e.g., U.S. Pat. No. 4,275,149). The enzyme generally catalyzes a chemical alteration of a chromogenic substrate that can be measured using various techniques. For example, the enzyme may catalyze a color change in a substrate, which can be measured spectrophotometrically. Alternatively, the enzyme may alter the fluorescence or chemiluminescence of the substrate. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRP), alkaline phosphatase (AP), β-galactosidase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like. Examples of enzyme-substrate combinations include, but are not limited to, horseradish peroxidase (HRP) with hydrogen peroxidase as a substrate, wherein the hydrogen peroxidase oxidizes a dye precursor (e.g., orthophenylene diamine (OPD) or 3,3',5,5'-tetramethylbenzidine hydrochloride (TMB)); alkaline phosphatase (AP) with para-nitrophenyl phosphate as chromogenic substrate; and β-D-galactosidase (β-D-Gal) with a chromogenic substrate (e.g., p-nitrophenyl-β-D-galactosidase) or fluorogenic substrate 4-methylumbelliferyl-β-D-galactosidase.

Aptamer(s) can be linked to a substrate such as a planar substrate. A planar array generally contains addressable locations (e.g., pads, addresses, or micro-locations) of biomolecules in an array format. The size of the array will depend on the composition and end use of the array. Arrays can be made containing from 2 different molecules to many thousands. Generally, the array comprises from two to as many as 100,000 or more molecules, depending on the end use of the array and the method of manufacture. A microarray for use with the invention comprises at least one biomolecule that identifies or captures a biomarker present in a biosignature of interest, e.g., a microRNA or other biomolecule or vesicle that makes up the biosignature. In some arrays, multiple substrates are used, either of different or identical compositions. Accordingly, planar arrays may comprise a plurality of smaller substrates.

The present invention can make use of many types of arrays for detecting a biomarker, e.g., a biomarker associated with a biosignature of interest. Useful arrays or microarrays include without limitation DNA microarrays, such as cDNA microarrays, oligonucleotide microarrays and SNP microarrays, microRNA arrays, protein microarrays, antibody microarrays, tissue microarrays, cellular microarrays (also called transfection microarrays), chemical compound microarrays, and carbohydrate arrays (glycoarrays). These arrays are described in more detail above. In some embodiments, microarrays comprise biochips that provide high-density immobilized arrays of recognition molecules (e.g., aptamers or antibodies), where biomarker binding is monitored indirectly (e.g., via fluorescence).

An array or microarray that can be used to detect one or more biomarkers of a biosignature and comprising one or more aptamers of the invention can be made according to the methods described in U.S. Pat. Nos. 6,329,209; 6,365,418; 6,406,921; 6,475,808; and 6,475,809, and U.S. patent application Ser. No. 10/884,269, each of which is herein incorporated by reference in its entirety. Custom arrays to detect specific selections of sets of biomarkers described herein can be made using the methods described in these patents. Commercially available microarrays can also be used to carry out the methods of the invention, including without limitation those from Affymetrix (Santa Clara, Calif.), Illumina (San Diego, Calif.), Agilent (Santa Clara, Calif.), Exiqon (Denmark), or Invitrogen (Carlsbad, Calif.). Custom and/or commercial arrays include arrays for detection proteins, nucleic acids, and other biological molecules and entities (e.g., cells, vesicles, virii) as described herein.

In some embodiments, multiple capture molecules are disposed on an array, e.g., proteins, peptides or additional nucleic acid molecules. In certain embodiments, the proteins are immobilized using methods and materials that minimize the denaturing of the proteins, that minimize alterations in the activity of the proteins, or that minimize interactions between the protein and the surface on which they are immobilized. The capture molecules can comprise one or more aptamer of the invention. In one embodiment, an array is constructed for the hybridization of a pool of aptamers. The array can then be used to identify pool members that bind a sample, thereby facilitating characterization of a phenotype. See FIGS. 19B-19C and related disclosure for further details.

Array surfaces useful may be of any desired shape, form, or size. Non-limiting examples of surfaces include chips, continuous surfaces, curved surfaces, flexible surfaces, films, plates, sheets, or tubes. Surfaces can have areas ranging from approximately a square micron to approximately 500 cm$^2$. The area, length, and width of surfaces may be varied according to the requirements of the assay to be performed. Considerations may include, for example, ease of handling, limitations of the material(s) of which the surface is formed, requirements of detection systems, requirements of deposition systems (e.g., arrayers), or the like.

In certain embodiments, it is desirable to employ a physical means for separating groups or arrays of binding islands or immobilized biomolecules: such physical separation facilitates exposure of different groups or arrays to different solutions of interest. Therefore, in certain embodiments, arrays are situated within microwell plates having any number of wells. In such embodiments, the bottoms of the wells may serve as surfaces for the formation of arrays, or arrays may be formed on other surfaces and then placed into wells. In certain embodiments, such as where a surface without wells is used, binding islands may be formed or molecules may be immobilized on a surface and a gasket having holes spatially arranged so that they correspond to the islands or biomolecules may be placed on the surface. Such a gasket is preferably liquid tight. A gasket may be placed on a surface at any time during the process of making the array and may be removed if separation of groups or arrays is no longer desired.

In some embodiments, the immobilized molecules can bind to one or more biomarkers or vesicles present in a biological sample contacting the immobilized molecules. In some embodiments, the immobilized molecules modify or are modified by molecules present in the one or more vesicles contacting the immobilized molecules. Contacting the sample typically comprises overlaying the sample upon the array.

Modifications or binding of molecules in solution or immobilized on an array can be detected using detection techniques known in the art. Examples of such techniques include immunological techniques such as competitive binding assays and sandwich assays; fluorescence detection using instruments such as confocal scanners, confocal microscopes, or CCD-based systems and techniques such as fluorescence, fluorescence polarization (FP), fluorescence resonant energy transfer (FRET), total internal reflection fluorescence (TIRF), fluorescence correlation spectroscopy (FCS); colorimetric/spectrometric techniques; surface plasmon resonance, by which changes in mass of materials adsorbed at surfaces are measured; techniques using radioisotopes, including conventional radioisotope binding and scintillation proximity assays (SPA); mass spectroscopy, such as matrix-assisted laser desorption/ionization mass spectroscopy (MALDI) and MALDI-time of flight (TOF) mass spectroscopy; ellipsometry, which is an optical method of measuring thickness of protein films; quartz crystal microbalance (QCM), a very sensitive method for measuring mass of materials adsorbing to surfaces; scanning probe microscopies, such as atomic force microscopy (AFM), scanning force microscopy (SFM) or scanning electron microscopy (SEM); and techniques such as electrochemical, impedance, acoustic, microwave, and IR/Raman detection. See, e.g., Mere L, et al., "*Miniaturized FRET assays and microfluidics: key components for ultra-high-throughput screening,*" *Drug Discovery Today* 4(8):363-369 (1999), and references cited therein; Lakowicz J R, *Principles of Fluorescence Spectroscopy*, 2nd Edition, Plenum Press (1999), or Jain K K: *Integrative Omics, Pharmacoproteomics, and Human Body Fluids. In: Thongboonkerd V, ed., ed. Proteomics of Human Body Fluids: Principles, Methods and Applications*. Volume 1: Totowa, N.J. Humana Press, 2007, each of which is herein incorporated by reference in its entirety.

Microarray technology can be combined with mass spectroscopy (MS) analysis and other tools. Electrospray interface to a mass spectrometer can be integrated with a capillary in a microfluidics device. For example, one commercially available system contains eTag reporters that are fluorescent labels with unique and well-defined electrophoretic mobilities; each label is coupled to biological or chemical probes via cleavable linkages. The distinct mobility address of each eTag reporter allows mixtures of these tags to be rapidly deconvoluted and quantitated by capillary electrophoresis. This system allows concurrent gene expression, protein expression, and protein function analyses from the same sample Jain K K: *Integrative Omics, Pharmacoproteomics, and Human Body Fluids. In: Thongboonkerd V, ed., ed. Proteomics of Human Body Fluids: Principles, Methods and Applications*. Volume 1: Totowa, N.J.: Humana Press, 2007, which is herein incorporated by reference in its entirety.

A biochip can include components for a microfluidic or nanofluidic assay. A microfluidic device can be used for isolating or analyzing biomarkers, such as determining a biosignature. Microfluidic systems allow for the miniaturization and compartmentalization of one or more processes for isolating, capturing or detecting a vesicle, detecting a microRNA, detecting a circulating biomarker, detecting a biosignature, and other processes. The microfluidic devices can use one or more detection reagents in at least one aspect of the system, and such a detection reagent can be used to detect one or more biomarkers. In one embodiment, the device detects a biomarker on an isolated or bound vesicle. Various probes, antibodies, proteins, or other binding agents can be used to detect a biomarker within the microfluidic system. The detection agents may be immobilized in different compartments of the microfluidic device or be entered into a hybridization or detection reaction through various channels of the device.

A vesicle in a microfluidic device can be lysed and its contents detected within the microfluidic device, such as proteins or nucleic acids, e.g., DNA or RNA such as miRNA or mRNA. The nucleic acid may be amplified prior to detection, or directly detected, within the microfluidic device. Thus microfluidic system can also be used for multiplexing detection of various biomarkers. In an embodiment, vesicles are captured within the microfluidic device, the captured vesicles are lysed, and a biosignature of microRNA from the vesicle payload is determined. The biosignature can further comprise the capture agent used to capture the vesicle.

Novel nanofabrication techniques are opening up the possibilities for biosensing applications that rely on fabrication of high-density, precision arrays, e.g., nucleotide-based chips and protein arrays otherwise known as heterogeneous nanoarrays. Nanofluidics allows a further reduction in the quantity of fluid analyte in a microchip to nanoliter levels, and the chips used here are referred to as nanochips. See, e.g., Unger M et al., *Biotechniques* 1999; 27(5):1008-14, Kartalov E P et al., *Biotechniques* 2006; 40(1):85-90, each of which are herein incorporated by reference in their entireties. Commercially available nanochips currently provide simple one step assays such as total cholesterol, total protein or glucose assays that can be run by combining sample and reagents, mixing and monitoring of the reaction. Gel-free analytical approaches based on liquid chromatography (LC) and nanoLC separations (Cutillas et al. *Proteomics*, 2005; 5:101-112 and Cutillas et al., *Mol Cell Proteomics* 2005; 4:1038-1051, each of which is herein incorporated by reference in its entirety) can be used in combination with the nanochips.

An array suitable for identifying a disease, condition, syndrome or physiological status can be included in a kit. A kit can include, an aptamer of the invention, including as non-limiting examples, one or more reagents useful for preparing molecules for immobilization onto binding islands or areas of an array, reagents useful for detecting binding of a vesicle to immobilized molecules, and instructions for use.

Further provided herein is a rapid detection device that facilitates the detection of a particular biosignature in a biological sample. The device can integrate biological sample preparation with polymerase chain reaction (PCR)

on a chip. The device can facilitate the detection of a particular biosignature of a vesicle in a biological sample, and an example is provided as described in Pipper et al., *Angewandte Chemie*, 47(21), p. 3900-3904 (2008), which is herein incorporated by reference in its entirety. A biosignature can be incorporated using micro-/nano-electrochemical system (MEMS/NEMS) sensors and oral fluid for diagnostic applications as described in Li et al., *Adv Dent Res* 18(1): 3-5 (2005), which is herein incorporated by reference in its entirety.

Particle Arrays

As an alternative to planar arrays, assays using particles, such as bead based assays are also capable of use with an aptamer of the invention. Aptamers are easily conjugated with commercially available beads. See, e.g., Srinivas et al. Anal. Chem. 2011 Oct. 21, *Aptamer functionalized Microgel Particles for Protein Detection*; See also, review article on aptamers as therapeutic and diagnostic agents, Brody and Gold, Rev. Mol. Biotech. 2000, 74:5-13.

Multiparametric assays or other high throughput detection assays using bead coatings with cognate ligands and reporter molecules with specific activities consistent with high sensitivity automation can be used. In a bead based assay system, a binding agent for a biomarker or vesicle, such as a capture agent (e.g. capture antibody), can be immobilized on an addressable microsphere. Each binding agent for each individual binding assay can be coupled to a distinct type of microsphere (i.e., microbead) and the assay reaction takes place on the surface of the microsphere, such as depicted in FIG. 2B. A binding agent for a vesicle can be a capture antibody coupled to a bead. Dyed microspheres with discrete fluorescence intensities are loaded separately with their appropriate binding agent or capture probes. The different bead sets carrying different binding agents can be pooled as desired to generate custom bead arrays. Bead arrays are then incubated with the sample in a single reaction vessel to perform the assay.

Bead-based assays can also be used with one or more aptamers of the invention. A bead substrate can provide a platform for attaching one or more binding agents, including aptamer(s). For multiplexing, multiple different bead sets (e.g., Illumina, Luminex) can have different binding agents (specific to different target molecules). For example, a bead can be conjugated to an aptamer of the invention used to detect the presence (quantitatively or qualitatively) of an antigen of interest, or it can also be used to isolate a component present in a selected biological sample (e.g., cell, cell-fragment or vesicle comprising the target molecule to which the aptamer is configured to bind or associate). Any molecule of organic origin can be successfully conjugated to a polystyrene bead through use of commercially available kits.

One or more aptamers of the invention can be used with any bead based substrate, including but not limited to magnetic capture method, fluorescence activated cell sorting (FACS) or laser cytometry. Magnetic capture methods can include, but are not limited to, the use of magnetically activated cell sorter (MACS) microbeads or magnetic columns. Examples of bead or particle based methods that can be modified to use an aptamer of the invention include methods and bead systems described in U.S. Pat. Nos. 4,551,435; 4,795,698; 4,925,788; 5,108,933; 5,186,827; 5,200,084 or 5,158,871; 7,399,632; 8,124,015; 8,008,019; 7,955,802; 7,445,844; 7,274,316; 6,773,812; 6,623,526; 6,599,331; 6,057,107; 5,736,330; International Patent Publication No. WO/2012/174282; WO/1993/022684.

Flow Cytometry

Isolation or detection of circulating biomarkers, e.g., protein antigens, from a biological sample, or of the biomarker-comprising cells, cell fragments or vesicles may also be achieved using an aptamer of the invention in a cytometry process. As a non-limiting example, aptamers of the invention can be used in an assay comprising using a particle such as a bead or microsphere The invention provides aptamers as binding agents, which may be conjugated to the particle. Flow cytometry can be used for sorting microscopic particles suspended in a stream of fluid. As particles pass through they can be selectively charged and on their exit can be deflected into separate paths of flow. It is therefore possible to separate populations from an original mix, such as a biological sample, with a high degree of accuracy and speed. Flow cytometry allows simultaneous multiparametric analysis of the physical and/or chemical characteristics of single cells flowing through an optical/electronic detection apparatus. A beam of light, usually laser light, of a single frequency (color) is directed onto a hydrodynamically focused stream of fluid. A number of detectors are aimed at the point where the stream passes through the light beam; one in line with the light beam (Forward Scatter or FSC) and several perpendicular to it (Side Scatter or SSC) and one or more fluorescent detectors.

Each suspended particle passing through the beam scatters the light in some way, and fluorescent chemicals in the particle may be excited into emitting light at a lower frequency than the light source. This combination of scattered and fluorescent light is picked up by the detectors, and by analyzing fluctuations in brightness at each detector (one for each fluorescent emission peak), it is possible to deduce various facts about the physical and chemical structure of each individual particle. FSC correlates with the cell size and SSC depends on the inner complexity of the particle, such as shape of the nucleus, the amount and type of cytoplasmic granules or the membrane roughness. Some flow cytometers have eliminated the need for fluorescence and use only light scatter for measurement.

Flow cytometers can analyze several thousand particles every second in "real time" and can actively separate out and isolate particles having specified properties. They offer high-throughput automated quantification, and separation, of the set parameters for a high number of single cells during each analysis session. Flow cytometers can have multiple lasers and fluorescence detectors, allowing multiple labels to be used to more precisely specify a target population by their phenotype. Thus, a flow cytometer, such as a multicolor flow cytometer, can be used to detect one or more vesicles with multiple fluorescent labels or colors. In some embodiments, the flow cytometer can also sort or isolate different vesicle populations, such as by size or by different markers.

The flow cytometer may have one or more lasers, such as 1, 2, 3, 4, 5, 6, 7, 8, 9, 10 or more lasers. In some embodiments, the flow cytometer can detect more than one color or fluorescent label, such as at least 2, 3, 4, 5, 6, 7, 8, 9, 10, 11, 12, 13, 14, 15, 16, 17, 18, 19, or 20 different colors or fluorescent labels. For example, the flow cytometer can have at least 2, 3, 4, 5, 6, 7, 8, 9, 10, 11, 12, 13, 14, 15, 16, 17, 18, 19, or 20 fluorescence detectors.

Examples of commercially available flow cytometers that can be used to detect or analyze one or more vesicles, to sort or separate different populations of vesicles, include, but are not limited to the MoFlo™ XDP Cell Sorter (Beckman Coulter, Brea, Calif.), MoFlo™ Legacy Cell Sorter (Beckman Coulter, Brea, Calif.), BD FACSAria™ Cell Sorter (BD Biosciences, San Jose, Calif.), BD™ LSRII (BD Biosciences, San Jose, Calif.), and BD FACSCalibur™ (BD Biosciences, San Jose, Calif.). Use of multicolor or multi-fluor cytometers can be used in multiplex analysis of vesicles, as further described below. In some embodiments, the flow cytometer can sort, and thereby collect or sort more than one population of vesicles based one or more characteristics. For example, two populations of vesicles differ in size, such that the vesicles within each population have a similar size range and can be differentially detected or sorted. In another embodiment, two different populations of vesicles are differentially labeled.

The data resulting from flow-cytometers can be plotted in 1 dimension to produce histograms or seen in 2 dimensions as dot plots or in 3 dimensions with newer software. The regions on these plots can be sequentially separated by a series of subset extractions which are termed gates. Specific gating protocols exist for diagnostic and clinical purposes especially in relation to hematology. The plots are often made on logarithmic scales. Because different fluorescent dye's emission spectra overlap, signals at the detectors have to be compensated electronically as well as computationally. Fluorophores for labeling biomarkers may include those described in Ormerod, *Flow Cytometry 2nd ed.*, Springer-Verlag, New York (1999), and in Nida et al., *Gynecologic Oncology* 2005; 4 889-894 which is incorporated herein by reference. In a multiplexed assay, including but not limited to a flow cytometry assay, one or more different target molecules can be assessed, wherein at least one of the target molecules is a microvesicle surface antigen assessed using an aptamer of the invention.

Microfluidics

One or more aptamer of the invention can be disposed on any useful planar or bead substrate. In one aspect of the invention one or more aptamer of the invention is disposed on a microfluidic device, thereby facilitating assessing, characterizing or isolating a component of a biological sample comprising a polypeptide antigen of interest or a functional fragment thereof. For example, the circulating antigen or a cell, cell fragment or cell-derived vesicles comprising the antigen can be assessed using one or more aptamers of the invention (alternatively along with additional binding agents). Microfluidic devices, which may also be referred to as "lab-on-a-chip" systems, biomedical micro-electro-mechanical systems (bioMEMs), or multicomponent integrated systems, can be used for isolating and analyzing a vesicle. Such systems miniaturize and compartmentalize processes that allow for binding of vesicles, detection of biosignatures, and other processes.

A microfluidic device can also be used for isolation of a vesicle through size differential or affinity selection. For example, a microfluidic device can use one more channels for isolating a vesicle from a biological sample based on size or by using one or more binding agents for isolating a vesicle from a biological sample. A biological sample can be introduced into one or more microfluidic channels, which selectively allows the passage of a vesicle. The selection can be based on a property of the vesicle, such as the size, shape, deformability, or biosignature of the vesicle.

In one embodiment, a heterogeneous population of vesicles can be introduced into a microfluidic device, and one or more different homogeneous populations of vesicles can be obtained. For example, different channels can have different size selections or binding agents to select for different vesicle populations. Thus, a microfluidic device can isolate a plurality of vesicles wherein at least a subset of the plurality of vesicles comprises a different biosignature from another subset of the plurality of vesicles. For example, the microfluidic device can isolate at least 2, 3, 4, 5, 6, 7, 8, 9, 10, 15, 20, 25, 30, 40, 50, 60, 70, 80, 90, or 100 different subsets of vesicles, wherein each subset of vesicles comprises a different biosignature.

In some embodiments, the microfluidic device can comprise one or more channels that permit further enrichment or selection of a vesicle. A population of vesicles that has been enriched after passage through a first channel can be introduced into a second channel, which allows the passage of the desired vesicle or vesicle population to be further enriched, such as through one or more binding agents present in the second channel.

Array-based assays and bead-based assays can be used with microfluidic device. For example, the binding agent can be coupled to beads and the binding reaction between the beads and vesicle can be performed in a microfluidic device. Multiplexing can also be performed using a microfluidic device. Different compartments can comprise different binding agents for different populations of vesicles, where each population is of a different cell-of-origin specific vesicle population. In one embodiment, each population has a different biosignature. The hybridization reaction between the microsphere and vesicle can be performed in a microfluidic device and the reaction mixture can be delivered to a detection device. The detection device, such as a dual or multiple laser detection system can be part of the microfluidic system and can use a laser to identify each bead or microsphere by its color-coding, and another laser can detect the hybridization signal associated with each bead.

Any appropriate microfluidic device can be used in the methods of the invention. Examples of microfluidic devices that may be used, or adapted for use with vesicles, include but are not limited to those described in U.S. Pat. Nos. 7,591,936, 7,581,429, 7,579,136, 7,575,722, 7,568,399, 7,552,741, 7,544,506, 7,541,578, 7,518,726, 7,488,596, 7,485,214, 7,467,928, 7,452,713, 7,452,509, 7,449,096, 7,431,887, 7,422,725, 7,422,669, 7,419,822, 7,419,639, 7,413,709, 7,411,184, 7,402,229, 7,390,463, 7,381,471, 7,357,864, 7,351,592, 7,351,380, 7,338,637, 7,329,391, 7,323,140, 7,261,824, 7,258,837, 7,253,003, 7,238,324, 7,238,255, 7,233,865, 7,229,538, 7,201,881, 7,195,986, 7,189,581, 7,189,580, 7,189,368, 7,141,978, 7,138,062, 7,135,147, 7,125,711, 7,118,910, 7,118,661, 7,640,947, 7,666,361, 7,704,735; and International Patent Publication WO 2010/072410; each of which patents or applications are incorporated herein by reference in their entirety. Another example for use with methods disclosed herein is described in Chen et al., "Microfluidic isolation and transcriptome analysis of serum vesicles," Lab on a Chip, Dec. 8, 2009 DOI: 10.1039/b916199f.

Other microfluidic devices for use with the invention include devices comprising elastomeric layers, valves and pumps, including without limitation those disclosed in U.S. Pat. Nos. 5,376,252, 6,408,878, 6,645,432, 6,719,868, 6,793,753, 6,899,137, 6,929,030, 7,040,338, 7,118,910, 7,144,616, 7,216,671, 7,250,128, 7,494,555, 7,501,245, 7,601,270, 7,691,333, 7,754,010, 7,837,946; U.S. Patent Application Nos. 2003/0061687, 2005/0084421, 2005/0112882, 2005/0129581, 2005/0145496, 2005/0201901, 2005/0214173, 2005/0252773, 2006/0006067; and EP Patent Nos. 0527905 and 1065378; each of which application is herein incorporated by reference. In some instances, much or all of the devices are composed of elastomeric material. Certain devices are designed to conduct thermal cycling reactions (e.g., PCR) with devices that include one or more elastomeric valves to regulate solution flow through the device. The devices can comprise arrays of reaction sites thereby allowing a plurality of reactions to be performed.

Thus, the devices can be used to assess circulating microRNAs in a multiplex fashion, including microRNAs isolated from vesicles. In an embodiment, the microfluidic device comprises (a) a first plurality of flow channels formed in an elastomeric substrate; (b) a second plurality of flow channels formed in the elastomeric substrate that intersect the first plurality of flow channels to define an array of reaction sites, each reaction site located at an intersection of one of the first and second flow channels; (c) a plurality of isolation valves disposed along the first and second plurality of flow channels and spaced between the reaction sites that can be actuated to isolate a solution within each of the reaction sites from solutions at other reaction sites, wherein the isolation valves comprise one or more control channels that each overlay and intersect one or more of the flow channels; and (d) means for simultaneously actuating the valves for isolating the reaction sites from each other. Various modifications to the basic structure of the device are envisioned within the scope of the invention. MicroRNAs can be detected in each of the reaction sites by using PCR methods. For example, the method can comprise the steps of the steps of: (i) providing a microfluidic device, the microfluidic device comprising: a first fluidic channel having a first end and a second end in fluid communication with each other through the channel; a plurality of flow channels, each flow channel terminating at a terminal wall; wherein each flow channel branches from and is in fluid communication with the first fluidic channel, wherein an aqueous fluid that enters one of the flow channels from the first fluidic channel can flow out of the flow channel only through the first fluidic channel; and, an inlet in fluid communication with the first fluidic channel, the inlet for introducing a sample fluid; wherein each flow channel is associated with a valve that when closed isolates one end of the flow channel from the first fluidic channel, whereby an isolated reaction site is formed between the valve and the terminal wall; a control channel; wherein each the valve is a deflectable membrane which is deflected into the flow channel associated with the valve when an actuating force is applied to the control channel, thereby closing the valve; and wherein when the actuating force is applied to the control channel a valve in each of the flow channels is closed, so as to produce the isolated reaction site in each flow channel; (ii) introducing the sample fluid into the inlet, the sample fluid filling the flow channels; (iii) actuating the valve to separate the sample fluid into the separate portions within the flow channels; (iv) amplifying the nucleic acid in the sample fluid; (v) analyzing the portions of the sample fluid to determine whether the amplifying produced the reaction. The sample fluid can contain an amplifiable nucleic acid target, e.g., a microRNA, and the conditions can be polymerase chain reaction (PCR) conditions, so that the reaction results in a PCR product being formed.

The microfluidic device can have one or more binding agents attached to a surface in a channel, or present in a channel. For example, the microchannel can have one or more capture agents, such as a capture agent for a tissue related antigen in Table 4, one or more general microvesicle antigen in Table 3 or a cell-of-origin or cancer related antigen in Table 4, including without limitation EpCam, CD9, CD63, CD81, B7H3, ICAM, STEAP, KLK2, SSx2, SSx4, PBP, SPDEF, and EGFR. The capture agent may be an aptamer selected by the methods of the invention. The surface of the channel can also be contacted with a blocking aptamer. In one embodiment, a microchannel surface is treated with avidin and a capture agent, such as an antibody, that is biotinylated can be injected into the channel to bind the avidin. In other embodiments, the capture agents are present in chambers or other components of a microfluidic device. The capture agents can also be attached to beads that can be manipulated to move through the microfluidic channels. In one embodiment, the capture agents are attached to magnetic beads. The beads can be manipulated using magnets.

A biological sample can be flowed into the microfluidic device, or a microchannel, at rates such as at least about 1, 2, 3, 4, 5, 6, 7, 8, 9, 10, 11, 12, 13, 14, 15, 16, 17, 18, 19, 20, 25, 30, 35, 40, 45, or 50 µl per minute, such as between about 1-50, 5-40, 5-30, 3-20 or 5-15 µl per minute. One or more vesicles can be captured and directly detected in the microfluidic device. Alternatively, the captured vesicle may be released and exit the microfluidic device prior to analysis. In another embodiment, one or more captured vesicles are lysed in the microchannel and the lysate can be analyzed, e.g., to examine payload within the vesicles. Lysis buffer can be flowed through the channel and lyse the captured vesicles. For example, the lysis buffer can be flowed into the device or microchannel at rates such as at least about a, 2, 3, 4, 5, 6, 7, 8, 9, 10, 11, 12, 13, 14, 15, 16, 17, 18, 19, 20, 25, 26, 27, 28, 29, 30, 35, 40, 45, or 50 µl per minute, such as between about 1-50, 5-40, 10-30, 5-30 or 10-35 µl per minute. The lysate can be collected and analyzed, such as performing RT-PCR, PCR, mass spectrometry, Western blotting, or other assays, to detect one or more biomarkers of the vesicle.

Phenotypes

Disclosed herein are products and processes for characterizing a phenotype using the methods and compositions of the invention. The term "phenotype" as used herein can mean any trait or characteristic that is attributed to a biomarker profile that is identified using in part or in whole the compositions and/or methods of the invention. For example, a phenotype can be a diagnostic, prognostic or theranostic determination based on a characterized biomarker profile for a sample obtained from a subject. A phenotype can be any observable characteristic or trait of, such as a disease or condition, a stage of a disease or condition, susceptibility to a disease or condition, prognosis of a disease stage or condition, a physiological state, or response/potential response to therapeutics. A phenotype can result from a subject's genetic makeup as well as the influence of environmental factors and the interactions between the two, as well as from epigenetic modifications to nucleic acid sequences.

A phenotype in a subject can be characterized by obtaining a biological sample from a subject and analyzing the sample using the compositions and/or methods of the invention. For example, characterizing a phenotype for a subject or individual can include detecting a disease or condition (including pre-symptomatic early stage detecting), determining a prognosis, diagnosis, or theranosis of a disease or condition, or determining the stage or progression of a disease or condition. Characterizing a phenotype can include identifying appropriate treatments or treatment efficacy for specific diseases, conditions, disease stages and condition stages, predictions and likelihood analysis of disease progression, particularly disease recurrence, metastatic spread or disease relapse. A phenotype can also be a clinically distinct type or subtype of a condition or disease, such as a cancer or tumor. Phenotype determination can also be a determination of a physiological condition, or an assessment of organ distress or organ rejection, such as post-transplantation. The compositions and methods described herein allow assessment of a subject on an individual basis, which can provide benefits of more efficient and economical decisions in treatment.

In an aspect, the invention relates to the analysis of biomarkers such as microvesicles to provide a diagnosis, prognosis, and/or theranosis of a disease or condition. Theranostics includes diagnostic testing that provides the ability to affect therapy or treatment of a disease or disease state. Theranostics testing provides a theranosis in a similar manner that diagnostics or prognostic testing provides a diagnosis or prognosis, respectively. As used herein, theranostics encompasses any desired form of therapy related testing, including predictive medicine, personalized medicine, integrated medicine, pharmacodiagnostics and Dx/Rx partnering. Therapy related tests can be used to predict and assess drug response in individual subjects, i.e., to provide personalized medicine. Predicting a drug response can be determining whether a subject is a likely responder or a likely non-responder to a candidate therapeutic agent, e.g., before the subject has been exposed or otherwise treated with the treatment. Assessing a drug response can be monitoring a response to a drug, e.g., monitoring the subject's improvement or lack thereof over a time course after initiating the treatment. Therapy related tests are useful to select a subject for treatment who is particularly likely to benefit from the treatment or to provide an early and objective indication of treatment efficacy in an individual subject. Thus, analysis using the compositions and methods of the invention may indicate that treatment should be altered to select a more promising treatment, thereby avoiding the great expense of delaying beneficial treatment and avoiding the financial and morbidity costs of administering an ineffective drug(s).

Thus, the compositions and methods of the invention may help predict whether a subject is likely to respond to a treatment for a disease or disorder. Characterizating a phenotype includes predicting the responder/non-responder status of the subject, wherein a responder responds to a treatment for a disease and a non-responder does not respond to the treatment. Biomarkers such as microvesicles can be analyzed in the subject and compared against that of previous subjects that were known to respond or not to a treatment. If the biomarker profile in the subject more closely aligns with that of previous subjects that were known to respond to the treatment, the subject can be characterized, or predicted, as a responder to the treatment. Similarly, if the biomarker profile in the subject more closely aligns with that of previous subjects that did not respond to the treatment, the subject can be characterized, or predicted as a non-responder to the treatment. The treatment can be for any appropriate disease, disorder or other condition, including without limitation those disclosed herein.

In some embodiments, the phenotype comprises a disease or condition such as those listed in Tables 1 or 16. For example, the phenotype can comprise detecting the presence of or likelihood of developing a tumor, neoplasm, or cancer, or characterizing the tumor, neoplasm, or cancer (e.g., stage, grade, aggressiveness, likelihood of metastatis or recurrence, etc). Cancers that can be detected or assessed by methods or compositions described herein include, but are not limited to, breast cancer, ovarian cancer, lung cancer, colon cancer, hyperplastic polyp, adenoma, colorectal cancer, high grade dysplasia, low grade dysplasia, prostatic hyperplasia, prostate cancer, melanoma, pancreatic cancer, brain cancer (such as a glioblastoma), hematological malignancy, hepatocellular carcinoma, cervical cancer, endometrial cancer, head and neck cancer, esophageal cancer, gastrointestinal stromal tumor (GIST), renal cell carcinoma (RCC) or gastric cancer. The colorectal cancer can be CRC Dukes B or Dukes C-D. The hematological malignancy can be B-Cell Chronic Lymphocytic Leukemia, B-Cell Lymphoma-DLBCL, B-Cell Lymphoma-DLBCL-germinal center-like, B-Cell Lymphoma-DLBCL-activated B-cell-like, and Burkitt's lymphoma.

The phenotype can be a premalignant condition, such as actinic keratosis, atrophic gastritis, leukoplakia, erythroplasia, Lymphomatoid Granulomatosis, preleukemia, fibrosis, cervical dysplasia, uterine cervical dysplasia, xeroderma pigmentosum, Barrett's Esophagus, colorectal polyp, or other abnormal tissue growth or lesion that is likely to develop into a malignant tumor. Transformative viral infections such as HIV and HPV also present phenotypes that can be assessed according to the invention.

A cancer characterized by the methods of the invention can comprise, without limitation, a carcinoma, a sarcoma, a lymphoma or leukemia, a germ cell tumor, a blastoma, or other cancers. Carcinomas include without limitation epithelial neoplasms, squamous cell neoplasms squamous cell carcinoma, basal cell neoplasms basal cell carcinoma, transitional cell papillomas and carcinomas, adenomas and adenocarcinomas (glands), adenoma, adenocarcinoma, linitis plastica insulinoma, glucagonoma, gastrinoma, vipoma, cholangiocarcinoma, hepatocellular carcinoma, adenoid cystic carcinoma, carcinoid tumor of appendix, prolactinoma, oncocytoma, hurthle cell adenoma, renal cell carcinoma, grawitz tumor, multiple endocrine adenomas, endometrioid adenoma, adnexal and skin appendage neoplasms, mucoepidermoid neoplasms, cystic, mucinous and serous neoplasms, cystadenoma, pseudomyxoma peritonei, ductal, lobular and medullary neoplasms, acinar cell neoplasms, complex epithelial neoplasms, warthin's tumor, thymoma, specialized gonadal neoplasms, sex cord stromal tumor, thecoma, granulosa cell tumor, arrhenoblastoma, sertoli leydig cell tumor, glomus tumors, paraganglioma, pheochromocytoma, glomus tumor, nevi and melanomas, melanocytic nevus, malignant melanoma, melanoma, nodular melanoma, dysplastic nevus, lentigo maligna melanoma, superficial spreading melanoma, and malignant acral lentiginous melanoma. Sarcoma includes without limitation Askin's tumor, botryodies, chondrosarcoma, Ewing's sarcoma, malignant hemangio endothelioma, malignant schwannoma, osteosarcoma, soft tissue sarcomas including: alveolar soft part sarcoma, angiosarcoma, cystosarcoma phyllodes, dermatofibrosarcoma, desmoid tumor, desmoplastic small round cell tumor, epithelioid sarcoma, extraskeletal chondrosarcoma, extraskeletal osteosarcoma, fibrosarcoma, hemangiopericytoma, hemangiosarcoma, kaposi's sarcoma, leiomyosarcoma, liposarcoma, lymphangiosarcoma, lymphosarcoma, malignant fibrous histiocytoma, neurofibrosarcoma, rhabdomyosarcoma, and synovialsarcoma. Lymphoma and leukemia include without limitation chronic lymphocytic leukemia/small lymphocytic lymphoma, B-cell prolymphocytic leukemia, lymphoplasmacytic lymphoma (such as waldenstrom macroglobulinemia), splenic marginal zone lymphoma, plasma cell myeloma, plasmacytoma, monoclonal immunoglobulin deposition diseases, heavy chain diseases, extranodal marginal zone B cell lymphoma, also called malt lymphoma, nodal marginal zone B cell lymphoma (nmzl), follicular lymphoma, mantle cell lymphoma, diffuse large B cell lymphoma, mediastinal (thymic) large B cell lymphoma, intravascular large B cell lymphoma, primary effusion lymphoma, burkitt lymphoma/leukemia, T cell prolymphocytic leukemia, T cell large granular lymphocytic leukemia, aggressive NK cell leukemia, adult T cell leukemia/lymphoma, extranodal NK/T cell lymphoma, nasal type, enteropathy-type T cell lymphoma, hepatosplenic T cell lymphoma, blastic NK cell lymphoma, mycosis fungoides/sezary syndrome, primary cutaneous CD30-positive T cell lymphoproliferative disorders, primary cutaneous anaplastic large cell lymphoma, lymphomatoid papulosis, angioimmunoblastic T cell lymphoma, peripheral T cell lymphoma, unspecified, anaplastic large cell lymphoma, classical hodgkin lymphomas (nodular sclerosis, mixed cellularity, lymphocyte-rich, lymphocyte depleted or not depleted), and nodular lymphocyte-predominant hodgkin lymphoma. Germ cell tumors include without limitation germinoma, dysgerminoma, seminoma, nongerminomatous germ cell tumor, embryonal carcinoma, endodermal sinus tumor, choriocarcinoma, teratoma, polyembryoma, and gonadoblastoma. Blastoma includes without limitation nephroblastoma, medulloblastoma, and retinoblastoma. Other cancers include without limitation labial carcinoma, larynx carcinoma, hypopharynx carcinoma, tongue carcinoma, salivary gland carcinoma, gastric carcinoma, adenocarcinoma, thyroid cancer (medullary and papillary thyroid carcinoma), renal carcinoma, kidney parenchyma carcinoma, cervix carcinoma, uterine corpus carcinoma, endometrium carcinoma, chorion carcinoma, testis carcinoma, urinary carcinoma, melanoma, brain tumors such as glioblastoma, astrocytoma, meningioma, medulloblastoma and peripheral neuroectodermal tumors, gall bladder carcinoma, bronchial carcinoma, multiple myeloma, basalioma, teratoma, retinoblastoma, choroidea melanoma, seminoma, rhabdomyosarcoma, craniopharyngeoma, osteosarcoma, chondrosarcoma, myosarcoma, liposarcoma, fibrosarcoma, Ewing sarcoma, and plasmocytoma.

In a further embodiment, the cancer under analysis may be a lung cancer including non-small cell lung cancer and small cell lung cancer (including small cell carcinoma (oat cell cancer), mixed small cell/large cell carcinoma, and combined small cell carcinoma), colon cancer, breast cancer, prostate cancer, liver cancer, pancreas cancer, brain cancer, kidney cancer, ovarian cancer, stomach cancer, skin cancer, bone cancer, gastric cancer, breast cancer, pancreatic cancer, glioma, glioblastoma, hepatocellular carcinoma, papillary renal carcinoma, head and neck squamous cell carcinoma, leukemia, lymphoma, myeloma, or a solid tumor.

In embodiments, the cancer comprises an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sézary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenström macroglobulinemia; or Wilm's tumor. The methods of the invention can be used to characterize these and other cancers. Thus, characterizing a phenotype can be providing a diagnosis, prognosis or theranosis of one of the cancers disclosed herein.

In some embodiments, the cancer comprises an acute myeloid leukemia (AML), breast carcinoma, cholangiocarcinoma, colorectal adenocarcinoma, extrahepatic bile duct adenocarcinoma, female genital tract malignancy, gastric adenocarcinoma, gastroesophageal adenocarcinoma, gastrointestinal stromal tumors (GIST), glioblastoma, head and neck squamous carcinoma, leukemia, liver hepatocellular carcinoma, low grade glioma, lung bronchioloalveolar carcinoma (BAC), lung non-small cell lung cancer (NSCLC), lung small cell cancer (SCLC), lymphoma, male genital tract malignancy, malignant solitary fibrous tumor of the pleura (MSFT), melanoma, multiple myeloma, neuroendocrine tumor, nodal diffuse large B-cell lymphoma, non epithelial ovarian cancer (non-EOC), ovarian surface epithelial carcinoma, pancreatic adenocarcinoma, pituitary carcinomas, oligodendroglioma, prostatic adenocarcinoma, retroperitoneal or peritoneal carcinoma, retroperitoneal or peritoneal sarcoma, small intestinal malignancy, soft tissue tumor, thymic carcinoma, thyroid carcinoma, or uveal melanoma. The methods of the invention can be used to characterize these and other cancers. Thus, characterizing a phenotype can be providing a diagnosis, prognosis or theranosis of one of the cancers disclosed herein.

The phenotype can also be an inflammatory disease, immune disease, or autoimmune disease. For example, the disease may be inflammatory bowel disease (IBD), Crohn's disease (CD), ulcerative colitis (UC), pelvic inflammation, vasculitis, psoriasis, diabetes, autoimmune hepatitis, Multiple Sclerosis, Myasthenia Gravis, Type I diabetes, Rheumatoid Arthritis, Psoriasis, Systemic Lupus Erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis.

The phenotype can also comprise a cardiovascular disease, such as atherosclerosis, congestive heart failure, vulnerable plaque, stroke, or ischemia. The cardiovascular disease or condition can be high blood pressure, stenosis, vessel occlusion or a thrombotic event.

The phenotype can also comprise a neurological disease, such as Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The phenotype may also be a condition such as fibromyalgia, chronic neuropathic pain, or peripheral neuropathic pain.

The phenotype may also comprise an infectious disease, such as a bacterial, viral or yeast infection. For example, the disease or condition may be Whipple's Disease, Prion Disease, cirrhosis, methicillin-resistant *Staphylococcus aureus*, HIV, hepatitis, syphilis, meningitis, malaria, tuberculosis, or influenza. Viral proteins, such as HIV or HCV-like particles can be assessed in a vesicle, to characterize a viral condition.

The phenotype can also comprise a perinatal or pregnancy related condition (e.g. preeclampsia or preterm birth), metabolic disease or condition, such as a metabolic disease or condition associated with iron metabolism. For example, hepcidin can be assayed in a vesicle to characterize an iron deficiency. The metabolic disease or condition can also be diabetes, inflammation, or a perinatal condition.

The compositions and methods of the invention can be used to characterize these and other diseases and disorders that can be assessed via biomarkers. Thus, characterizing a phenotype can be providing a diagnosis, prognosis or theranosis of one of the diseases and disorders disclosed herein.

Subject

One or more phenotypes of a subject can be determined by analyzing one or more vesicles, such as vesicles, in a biological sample obtained from the subject. A subject or patient can include, but is not limited to, mammals such as bovine, avian, canine, equine, feline, ovine, porcine, or primate animals (including humans and non-human primates). A subject can also include a mammal of importance due to being endangered, such as a Siberian tiger; or economic importance, such as an animal raised on a farm for consumption by humans, or an animal of social importance to humans, such as an animal kept as a pet or in a zoo. Examples of such animals include, but are not limited to, carnivores such as cats and dogs; swine including pigs, hogs and wild boars; ruminants or ungulates such as cattle, oxen, sheep, giraffes, deer, goats, bison, camels or horses. Also included are birds that are endangered or kept in zoos, as well as fowl and more particularly domesticated fowl, i.e. poultry, such as turkeys and chickens, ducks, geese, guinea fowl. Also included are domesticated swine and horses (including race horses). In addition, any animal species connected to commercial activities are also included such as those animals connected to agriculture and aquaculture and other activities in which disease monitoring, diagnosis, and therapy selection are routine practice in husbandry for economic productivity and/or safety of the food chain.

The subject can have a pre-existing disease or condition, such as cancer. Alternatively, the subject may not have any known pre-existing condition. The subject may also be non-responsive to an existing or past treatment, such as a treatment for cancer.

Samples

A sample used and/or assessed via the compositions and methods of the invention includes any relevant biological sample that can be used for biomarker assessment, including without limitation sections of tissues such as biopsy or tissue removed during surgical or other procedures, bodily fluids, autopsy samples, frozen sections taken for histological purposes, and cell cultures. Such samples include blood and blood fractions or products (e.g., serum, buffy coat, plasma, platelets, red blood cells, and the like), sputum, malignant effusion, cheek cells tissue, cultured cells (e.g., primary cultures, explants, and transformed cells), stool, urine, other biological or bodily fluids (e.g., prostatic fluid, gastric fluid, intestinal fluid, renal fluid, lung fluid, cerebrospinal fluid, and the like), etc. The sample can comprise biological material that is a fresh frozen & formalin fixed paraffin embedded (FFPE) block, formalin-fixed paraffin embedded, or is within an RNA preservative+formalin fixative. More than one sample of more than one type can be used for each patient.

The sample used in the methods described herein can be a formalin fixed paraffin embedded (FFPE) sample. The FFPE sample can be one or more of fixed tissue, unstained slides, bone marrow core or clot, core needle biopsy, malignant fluids and fine needle aspirate (FNA). In an embodiment, the fixed tissue comprises a tumor containing formalin fixed paraffin embedded (FFPE) block from a surgery or biopsy. In another embodiment, the unstained slides comprise unstained, charged, unbaked slides from a paraffin block. In another embodiment, bone marrow core or clot comprises a decalcified core. A formalin fixed core and/or clot can be paraffin-embedded. In still another embodiment, the core needle biopsy comprises 1, 2, 3, 4, 5, 6, 7, 8, 9, 10 or more, e.g., 3-4, paraffin embedded biopsy samples. An 18 gauge needle biopsy can be used. The malignant fluid can comprise a sufficient volume of fresh pleural/ascitic fluid to produce a 5×5×2 mm cell pellet. The fluid can be formalin fixed in a paraffin block. In an embodiment, the core needle biopsy comprises 1, 2, 3, 4, 5, 6, 7, 8, 9, 10 or more, e.g., 4-6, paraffin embedded aspirates.

A sample may be processed according to techniques understood by those in the art. A sample can be without limitation fresh, frozen or fixed cells or tissue. In some embodiments, a sample comprises formalin-fixed paraffin-embedded (FFPE) tissue, fresh tissue or fresh frozen (FF) tissue. A sample can comprise cultured cells, including primary or immortalized cell lines derived from a subject sample. A sample can also refer to an extract from a sample from a subject. For example, a sample can comprise DNA, RNA or protein extracted from a tissue or a bodily fluid.

Many techniques and commercial kits are available for such purposes. The fresh sample from the individual can be treated with an agent to preserve RNA prior to further processing, e.g., cell lysis and extraction. Samples can include frozen samples collected for other purposes. Samples can be associated with relevant information such as age, gender, and clinical symptoms present in the subject; source of the sample; and methods of collection and storage of the sample. A sample is typically obtained from a subject.

A biopsy comprises the process of removing a tissue sample for diagnostic or prognostic evaluation, and to the tissue specimen itself. Any biopsy technique known in the art can be applied to the molecular profiling methods of the present invention. The biopsy technique applied can depend on the tissue type to be evaluated (e.g., colon, prostate, kidney, bladder, lymph node, liver, bone marrow, blood cell, lung, breast, etc.), the size and type of the tumor (e.g., solid or suspended, blood or ascites), among other factors. Representative biopsy techniques include, but are not limited to, excisional biopsy, incisional biopsy, needle biopsy, surgical biopsy, and bone marrow biopsy. An "excisional biopsy" refers to the removal of an entire tumor mass with a small margin of normal tissue surrounding it. An "incisional biopsy" refers to the removal of a wedge of tissue that includes a cross-sectional diameter of the tumor. Molecular profiling can use a "core-needle biopsy" of the tumor mass, or a "fine-needle aspiration biopsy" which generally obtains a suspension of cells from within the tumor mass. Biopsy techniques are discussed, for example, in Harrison's Principles of Internal Medicine, Kasper, et al., eds., 16th ed., 2005, Chapter 70, and throughout Part V.

Standard molecular biology techniques known in the art and not specifically described are generally followed as in Sambrook et al., Molecular Cloning: A Laboratory Manual, Cold Spring Harbor Laboratory Press, New York (1989), and as in Ausubel et al., Current Protocols in Molecular Biology, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683,202; 4,801,531; 5,192,659 and 5,272,057 and incorporated herein by reference. Polymerase chain reaction (PCR) can be carried out generally as in PCR Protocols: A Guide to Methods and Applications, Academic Press, San Diego, Calif. (1990).

The biological sample assessed using the compositions and methods of the invention can be any useful bodily or biological fluid, including but not limited to peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen (including prostatic fluid), Cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids, cells, cell culture, or a cell culture supernatant. A biological sample may also include the blastocyl cavity, umbilical cord blood, or maternal circulation which may be of fetal or maternal origin. The biological sample may also be a cell culture, tissue sample or biopsy from which vesicles and other circulating biomarkers may be obtained. For example, cells of interest can be cultured and vesicles isolated from the culture. In various embodiments, biomarkers or more particularly biosignatures disclosed herein can be assessed directly from such biological samples (e.g., identification of presence or levels of nucleic acid or polypeptide biomarkers or functional fragments thereof) using various methods, such as extraction of nucleic acid molecules from blood, plasma, serum or any of the foregoing biological samples, use of protein or antibody arrays to identify polypeptide (or functional fragment) biomarker(s), as well as other array, sequencing, PCR and proteomic techniques known in the art for identification and assessment of nucleic acid and polypeptide molecules. In addition, one or more components present in such samples can be first isolated or enriched and further processed to assess the presence or levels of selected biomarkers, to assess a given biosignature (e.g., isolated microvesicles prior to profiling for protein and/or nucleic acid biomarkers).

Table 1 presents a non-limiting listing of diseases, conditions, or biological states and corresponding biological samples that may be used for analysis according to the methods of the invention.

TABLE 1

Examples of Biological Samples for Various Diseases, Conditions, or Biological States

| Illustrative Disease, Condition or Biological State | Illustrative Biological Samples |
| --- | --- |
| Cancers/neoplasms affecting the following tissue types/bodily systems: breast, lung, ovarian, colon, rectal, prostate, pancreatic, brain, bone, connective tissue, glands, skin, lymph, nervous system, endocrine, germ cell, genitourinary, hematologic/blood, bone marrow, muscle, eye, esophageal, fat tissue, thyroid, pituitary, spinal cord, bile duct, heart, gall bladder, bladder, testes, cervical, endometrial, renal, ovarian, digestive/gastrointestinal, stomach, head and neck, liver, leukemia, respiratory/thorasic, cancers of unknown primary (CUP) | Tumor, blood, serum, plasma, cerebrospinal fluid (CSF), urine, sputum, ascites, synovial fluid, semen, nipple aspirates, saliva, bronchoalveolar lavage fluid, tears, oropharyngeal washes, feces, peritoneal fluids, pleural effusion, sweat, tears, aqueous humor, pericardial fluid, lymph, chyme, chyle, bile, stool water, amniotic fluid, breast milk, pancreatic juice, cerumen, Cowper's fluid or pre-ejaculatory fluid, female ejaculate, interstitial fluid, menses, mucus, pus, sebum, vaginal lubrication, vomit |
| Neurodegenerative/neurological disorders: Parkinson's disease, Alzheimer's Disease and multiple sclerosis, Schizophrenia, and bipolar disorder, spasticity disorders, epilepsy | Blood, serum, plasma, CSF, urine |

TABLE 1-continued

Examples of Biological Samples for Various Diseases, Conditions, or Biological States

| Illustrative Disease, Condition or Biological State | Illustrative Biological Samples |
| --- | --- |
| Cardiovascular Disease: atherosclerosis, cardiomyopathy, endocarditis, vunerable plaques, infection | Blood, serum, plasma, CSF, urine |
| Stroke: ischemic, intracerebral hemorrhage, subarachnoid hemorrhage, transient ischemic attacks (TIA) | Blood, serum, plasma, CSF, urine |
| Pain disorders: peripheral neuropathic pain and chronic neuropathic pain, and fibromyalgia, | Blood, serum, plasma, CSF, urine |
| Autoimmune disease: systemic and localized diseases, rheumatic disease, Lupus, Sjogren's syndrome | Blood, serum, plasma, CSF, urine, synovial fluid |
| Digestive system abnormalities: Barrett's esophagus, irritable bowel syndrome, ulcerative colitis, Crohn's disease, Diverticulosis and Diverticulitis, Celiac Disease | Blood, serum, plasma, CSF, urine |
| Endocrine disorders: diabetes mellitus, various forms of Thyroiditis, adrenal disorders, pituitary disorders | Blood, serum, plasma, CSF, urine |
| Diseases and disorders of the skin: psoriasis | Blood, serum, plasma, CSF, urine, synovial fluid, tears |
| Urological disorders: benign prostatic hypertrophy (BPH), polycystic kidney disease, interstitial cystitis | Blood, serum, plasma, urine |
| Hepatic disease/injury: Cirrhosis, induced hepatotoxicity (due to exposure to natural or synthetic chemical sources) | Blood, serum, plasma, urine |
| Kidney disease/injury: acute, sub-acute, chronic conditions, Podocyte injury, focal segmental glomerulosclerosis | Blood, serum, plasma, urine |
| Endometriosis | Blood, serum, plasma, urine, vaginal fluids |
| Osteoporosis | Blood, serum, plasma, urine, synovial fluid |
| Pancreatitis | Blood, serum, plasma, urine, pancreatic juice |
| Asthma | Blood, serum, plasma, urine, sputum, bronchiolar lavage fluid |
| Allergies | Blood, serum, plasma, urine, sputum, bronchiolar lavage fluid |
| Prion-related diseases | Blood, serum, plasma, CSF, urine |
| Viral Infections: HIV/AIDS | Blood, serum, plasma, urine |
| Sepsis | Blood, serum, plasma, urine, tears, nasal lavage |
| Organ rejection/transplantation | Blood, serum, plasma, urine, various lavage fluids |
| Differentiating conditions: adenoma versus hyperplastic polyp, irritable bowel syndrome (IBS) versus normal, classifying Dukes stages A, B, C, and/or D of colon cancer, adenoma with low-grade hyperplasia versus high-grade hyperplasia, adenoma versus normal, colorectal cancer versus normal, IBS versus. ulcerative colitis (UC) versus Crohn's disease (CD), | Blood, serum, plasma, urine, sputum, feces, colonic lavage fluid |
| Pregnancy related physiological states, conditions, or affiliated diseases: genetic risk, adverse pregnancy outcomes | Maternal serum, plasma, amniotic fluid, cord blood |

The methods of the invention can be used to characterize a phenotype using a blood sample or blood derivative. Blood derivatives include plasma and serum. Blood plasma is the liquid component of whole blood, and makes up approximately 55% of the total blood volume. It is composed primarily of water with small amounts of minerals, salts, ions, nutrients, and proteins in solution. In whole blood, red blood cells, leukocytes, and platelets are suspended within the plasma. Blood serum refers to blood plasma without fibrinogen or other clotting factors (i.e., whole blood minus both the cells and the clotting factors).

The biological sample may be obtained through a third party, such as a party not performing the analysis of the biomarkers, whether direct assessment of a biological sample or by profiling one or more vesicles obtained from the biological sample. For example, the sample may be obtained through a clinician, physician, or other health care manager of a subject from which the sample is derived. Alternatively, the biological sample may obtained by the same party analyzing the vesicle. In addition, biological samples be assayed, are archived (e.g., frozen) or otherwise stored in under preservative conditions.

Furthermore, a biological sample can comprise a vesicle or cell membrane fragment that is derived from a cell of origin and available extracellularly in a subject's biological fluid or extracellular milieu.

Methods of the invention can include assessing one or more vesicles, including assessing vesicle populations. A vesicle, as used herein, is a membrane vesicle that is shed from cells. Vesicles or membrane vesicles include without limitation: circulating microvesicles (cMVs), microvesicle, exosome, nanovesicle, dexosome, bleb, blebby, prostasome, microparticle, intralumenal vesicle, membrane fragment, intralumenal endosomal vesicle, endosomal-like vesicle, exocytosis vehicle, endosome vesicle, endosomal vesicle, apoptotic body, multivesicular body, secretory vesicle, phospholipid vesicle, liposomal vesicle, argosome, texasome, secresome, tolerosome, melanosome, oncosome, or exocytosed vehicle. Furthermore, although vesicles may be produced by different cellular processes, the methods of the invention are not limited to or reliant on any one mechanism, insofar as such vesicles are present in a biological sample and are capable of being characterized by the methods disclosed herein. Unless otherwise specified, methods that make use of a species of vesicle can be applied to other types of vesicles. Vesicles comprise spherical structures with a lipid bilayer similar to cell membranes which surrounds an inner compartment which can contain soluble components, sometimes referred to as the payload. In some embodiments, the methods of the invention make use of exosomes, which are small secreted vesicles of about 40-100 nm in diameter. For a review of membrane vesicles, including types and characterizations, see Thery et al., Nat Rev Immunol. 2009 August; 9(8):581-93. Some properties of different types of vesicles include those in Table 2:

tion and sealing of portions of the plasma membrane or from the export of any intracellular membrane-bounded vesicular structure containing various membrane-associated proteins of tumor origin, including surface-bound molecules derived from the host circulation that bind selectively to the tumor-derived proteins together with molecules contained in the vesicle lumen, including but not limited to tumor-derived microRNAs or intracellular proteins. Blebs and blebbing are further described in Charras et al., Nature Reviews Molecular and Cell Biology, Vol. 9, No. 11, p. 730-736 (2008). A vesicle shed into circulation or bodily fluids from tumor cells may be referred to as a "circulating tumor-derived vesicle." When such vesicle is an exosome, it may be referred to as a circulating-tumor derived exosome (CTE). In some instances, a vesicle can be derived from a specific cell of origin. CTE, as with a cell-of-origin specific vesicle, typically have one or more unique biomarkers that permit isolation of the CTE or cell-of-origin specific vesicle, e.g., from a bodily fluid and sometimes in a specific manner. For

TABLE 2

Vesicle Properties

| Feature | Exosomes | Microvesicles | Ectosomes | Membrane particles | Exosome-like vesicles | Apoptotic vesicles |
|---|---|---|---|---|---|---|
| Size | 50-100 nm | 100-1,000 nm | 50-200 nm | 50-80 nm | 20-50 nm | 50-500 nm |
| Density in sucrose | 1.13-1.19 g/ml | | | 1.04-1.07 g/ml | 1.1 g/ml | 1.16-1.28 g/ml |
| EM appearance | Cup shape | Irregular shape, electron dense | Bilamellar round structures | Round | Irregular shape | Heterogeneous |
| Sedimentation | 100,000 g | 10,000 g | 160,000-200,000 g | 100,000-200,000 g | 175,000 g | 1,200 g, 10,000 g, 100,000 g |
| Lipid composition | Enriched in cholesterol, sphingomyelin and ceramide; contains lipid rafts; expose PPS | Expose PPS | Enriched in cholesterol and diacylglycerol; expose PPS | | No lipid rafts | |
| Major protein markers | Tetraspanins (e.g., CD63, CD9), Alix, TSG101 | Integrins, selectins and CD40 ligand | CR1 and proteolytic enzymes; no CD63 | CD133; no CD63 | TNFRI | Histones |
| Intracellular origin | Internal compartments (endosomes) | Plasma membrane | Plasma membrane | Plasma membrane | | |

Abbreviations:
phosphatidylserine (PPS);
electron microscopy (EM)

Vesicles include shed membrane bound particles, or "microparticles," that are derived from either the plasma membrane or an internal membrane. Vesicles can be released into the extracellular environment from cells. Cells releasing vesicles include without limitation cells that originate from, or are derived from, the ectoderm, endoderm, or mesoderm. The cells may have undergone genetic, environmental, and/or any other variations or alterations. For example, the cell can be tumor cells. A vesicle can reflect any changes in the source cell, and thereby reflect changes in the originating cells, e.g., cells having various genetic mutations. In one mechanism, a vesicle is generated intracellularly when a segment of the cell membrane spontaneously invaginates and is ultimately exocytosed (see for example, Keller et al., Immunol. Lett. 107 (2): 102-8 (2006)). Vesicles also include cell-derived structures bounded by a lipid bilayer membrane arising from both herniated evagination (blebbing) separaexample, a cell or tissue specific markers are used to identify the cell of origin. Examples of such cell or tissue specific markers are disclosed herein and can further be accessed in the Tissue-specific Gene Expression and Regulation (TiGER) Database, available at bioinfo.wilmer.jhu.edu/tiger/; Liu et al. (2008) TiGER: a database for tissue-specific gene expression and regulation. BMC Bioinformatics. 9:271; TissueDistributionDBs, available at genome.dkfz-heidelberg.de/menu/tissue_db/index.html.

A vesicle can have a diameter of greater than about 10 nm, 20 nm, or 30 nm. A vesicle can have a diameter of greater than 40 nm, 50 nm, 100 nm, 200 nm, 500 nm, 1000 nm, 1500 nm, 2000 nm or greater than 10,000 nm. A vesicle can have a diameter of about 20-2000 nm, about 20-1500 nm, about 30-1000 nm, about 30-800 nm, about 30-200 nm, or about 30-100 nm. In some embodiments, the vesicle has a diameter of less than 10,000 nm, 2000 nm, 1500 nm, 1000 nm, 800 nm, 500 nm, 200 nm, 100 nm, 50 nm, 40 nm, 30 nm, 20 nm or less than 10 nm. As used herein the term "about" in reference to a numerical value means that variations of 10% above or below the numerical value are within the range ascribed to the specified value. Typical sizes for various types of vesicles are shown in Table 2. Vesicles can be assessed to measure the diameter of a single vesicle or any number of vesicles. For example, the range of diameters of a vesicle population or an average diameter of a vesicle population can be determined. Vesicle diameter can be assessed using methods known in the art, e.g., imaging technologies such as electron microscopy. In an embodiment, a diameter of one or more vesicles is determined using optical particle detection. See, e.g., U.S. Pat. No. 7,751,053, entitled "Optical Detection and Analysis of Particles" and issued Jul. 6, 2010; and U.S. Pat. No. 7,399,600, entitled "Optical Detection and Analysis of Particles" and issued Jul. 15, 2010.

Figure 19A:
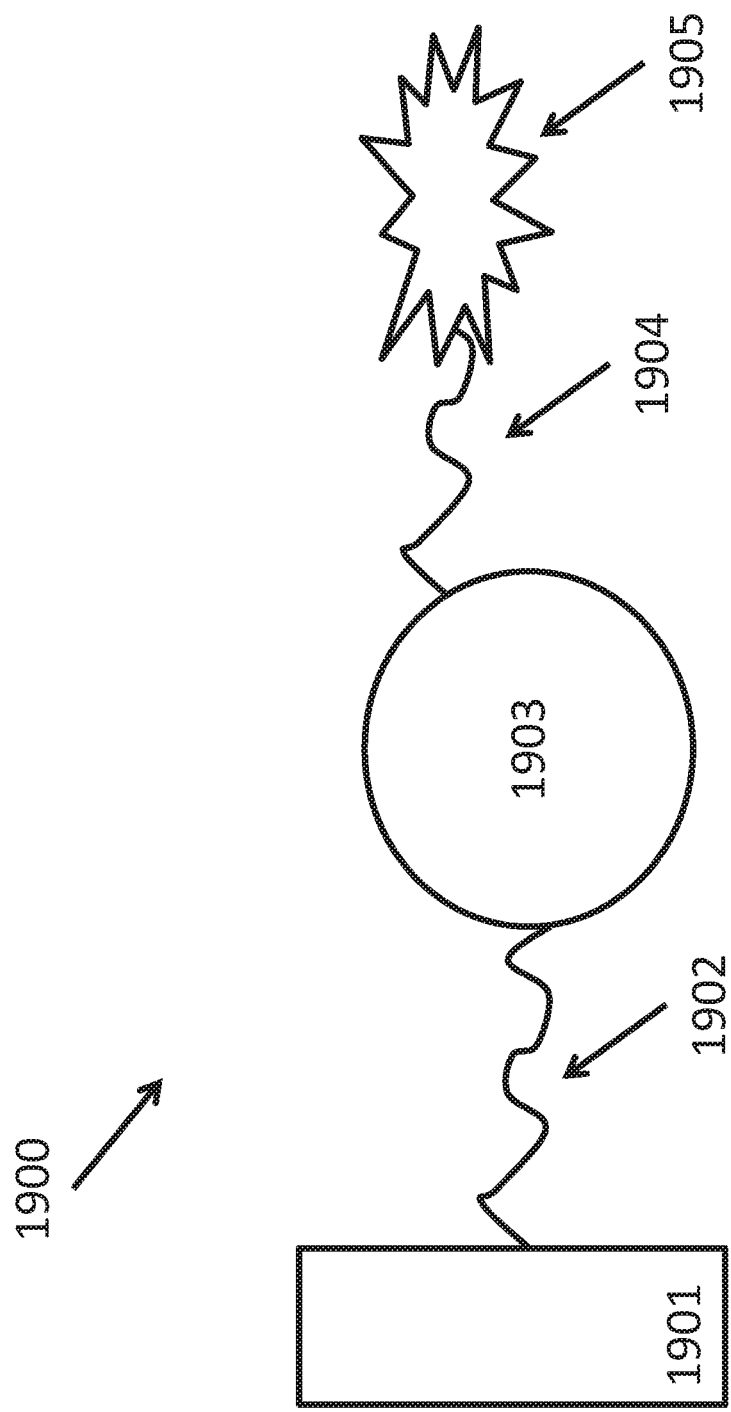
FIGS. 19A-C illustrate use of aptamers in methods of characterizing a phenotype.
Figure 19B:
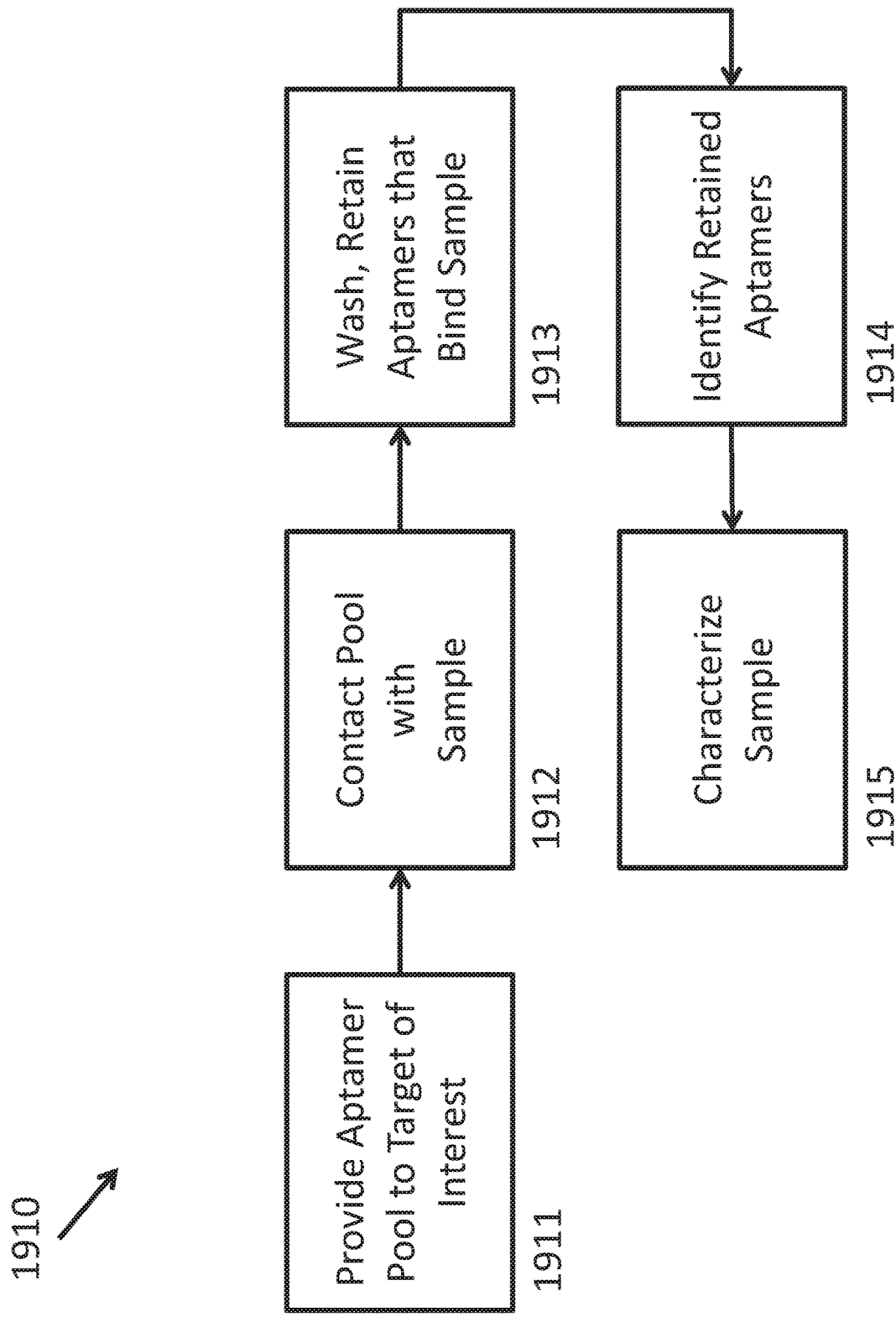
Figure 19C:
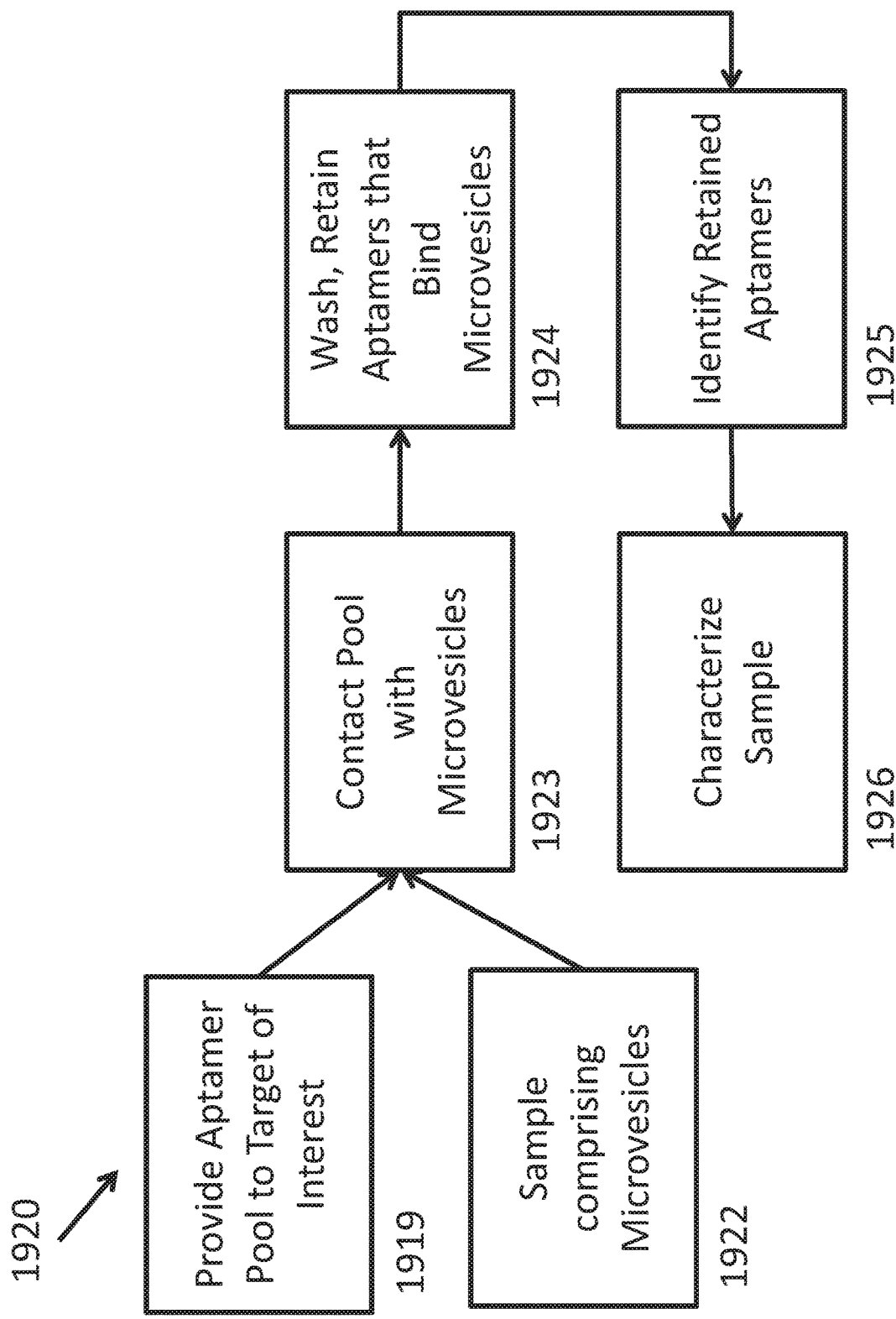

In some embodiments, the methods of the invention comprise assessing vesicles directly such as in a biological sample without prior isolation, purification, or concentration from the biological sample. For example, the amount of vesicles in the sample can by itself provide a biosignature that provides a diagnostic, prognostic or theranostic determination. Alternatively, the vesicle in the sample may be isolated, captured, purified, or concentrated from a sample prior to analysis. As noted, isolation, capture or purification as used herein comprises partial isolation, partial capture or partial purification apart from other components in the sample. Vesicle isolation can be performed using various techniques as described herein, e.g., chromatography, filtration, centrifugation, flow cytometry, affinity capture (e.g., to a planar surface or bead), and/or using microfluidics. FIGS. 19B-C present an overview of a method of the invention for assessing microvesicles using an aptamer pool.

Vesicles such as exosomes can be assessed to provide a phenotypic characterization by comparing vesicle characteristics to a reference. In some embodiments, surface antigens on a vesicle are assessed. The surface antigens can provide an indication of the anatomical origin and/or cellular of the vesicles and other phenotypic information, e.g., tumor status. For example, wherein vesicles found in a patient sample, e.g., a bodily fluid such as blood, serum or plasma, are assessed for surface antigens indicative of colorectal origin and the presence of cancer. The surface antigens may comprise any informative biological entity that can be detected on the vesicle membrane surface, including without limitation surface proteins, lipids, carbohydrates, and other membrane components. For example, positive detection of colon derived vesicles expressing tumor antigens can indicate that the patient has colorectal cancer. As such, methods of the invention can be used to characterize any disease or condition associated with an anatomical or cellular origin, by assessing, for example, disease-specific and cell-specific biomarkers of one or more vesicles obtained from a subject.

In another embodiment, the methods of the invention comprise assessing one or more vesicle payload to provide a phenotypic characterization. The payload with a vesicle comprises any informative biological entity that can be detected as encapsulated within the vesicle, including without limitation proteins and nucleic acids, e.g., genomic or cDNA, mRNA, or functional fragments thereof, as well as microRNAs (miRs). In addition, methods of the invention are directed to detecting vesicle surface antigens (in addition or exclusive to vesicle payload) to provide a phenotypic characterization. For example, vesicles can be characterized by using binding agents (e.g., antibodies or aptamers) that are specific to vesicle surface antigens, and the bound vesicles can be further assessed to identify one or more payload components disclosed therein. As described herein, the levels of vesicles with surface antigens of interest or with payload of interest can be compared to a reference to characterize a phenotype. For example, overexpression in a sample of cancer-related surface antigens or vesicle payload, e.g., a tumor associated mRNA or microRNA, as compared to a reference, can indicate the presence of cancer in the sample. The biomarkers assessed can be present or absent, increased or reduced based on the selection of the desired target sample and comparison of the target sample to the desired reference sample. Non-limiting examples of target samples include: disease; treated/not-treated; different time points, such as a in a longitudinal study; and non-limiting examples of reference sample: non-disease; normal; different time points; and sensitive or resistant to candidate treatment(s).

Microvesicle Isolation and Analysis

Sample Processing

A vesicle or a population of vesicles may be isolated, purified, concentrated or otherwise enriched prior to and/or during analysis. Unless otherwise specified, the terms "purified," "isolated," or similar as used herein in reference to vesicles or biomarker components are intended to include partial or complete purification or isolation of such components from a cell or organism. Analysis of a vesicle can include quantitating the amount one or more vesicle populations of a biological sample. For example, a heterogeneous population of vesicles can be quantitated, or a homogeneous population of vesicles, such as a population of vesicles with a particular biomarker profile, a particular biosignature, or derived from a particular cell type can be isolated from a heterogeneous population of vesicles and quantitated. Analysis of a vesicle can also include detecting, quantitatively or qualitatively, one or more particular biomarker profile or biosignature of a vesicle, as described herein.

A vesicle can be stored and archived, such as in a bio-fluid bank and retrieved for analysis as desired. A vesicle may also be isolated from a biological sample that has been previously harvested and stored from a living or deceased subject. In addition, a vesicle may be isolated from a biological sample which has been collected as described in King et al., *Breast Cancer Res* 7(5): 198-204 (2005). A vesicle can be isolated from an archived or stored sample. Alternatively, a vesicle may be isolated from a biological sample and analyzed without storing or archiving of the sample. Furthermore, a third party may obtain or store the biological sample, or obtain or store the vesicle for analysis.

An enriched population of vesicles can be obtained from a biological sample. For example, vesicles may be concentrated or isolated from a biological sample using size exclusion chromatography, density gradient centrifugation, differential centrifugation, nanomembrane ultrafiltration, immunoabsorbent capture, affinity purification, microfluidic separation, or combinations thereof.

Size exclusion chromatography, such as gel permeation columns, centrifugation or density gradient centrifugation, and filtration methods can be used. For example, a vesicle can be isolated by differential centrifugation, anion exchange and/or gel permeation chromatography (for example, as described in U.S. Pat. Nos. 6,899,863 and 6,812,023), sucrose density gradients, organelle electrophoresis (for example, as described in U.S. Pat. No. 7,198,923), magnetic activated cell sorting (MACS), or with a nanomembrane ultrafiltration concentrator. Various combinations of isolation or concentration methods can be used.

Highly abundant proteins, such as albumin and immunoglobulin in blood samples, may hinder isolation of vesicles from a biological sample. For example, a vesicle can be isolated from a biological sample using a system that uses multiple antibodies that are specific to the most abundant proteins found in a biological sample, such as blood. Such a system can remove up to several proteins at once, thus unveiling the lower abundance species such as cell-of-origin specific vesicles. This type of system can be used for isolation of vesicles from biological samples such as blood, cerebrospinal fluid or urine. The isolation of vesicles from a biological sample may also be enhanced by high abundant protein removal methods as described in Chromy et al. *J Proteome Res* 2004; 3:1120-1127. In another embodiment, the isolation of vesicles from a biological sample may also be enhanced by removing serum proteins using glycopeptide capture as described in Zhang et al, *Mol Cell Proteomics* 2005; 4:144-155. In addition, vesicles from a biological sample such as urine may be isolated by differential centrifugation followed by contact with antibodies directed to cytoplasmic or anti-cytoplasmic epitopes as described in Pisitkun et al., *Proc Natl Acad Sci USA,* 2004; 101:13368-13373.

Plasma contains a large variety of proteins including albumin, immunoglobulins, and clotting proteins such as fibrinogen. About 60% of plasma protein comprises the protein albumin (e.g., human serum albumin or HSA), which contributes to osmotic pressure of plasma to assist in the transport of lipids and steroid hormones. Globulins make up about 35% of plasma proteins and are used in the transport of ions, hormones and lipids assisting in immune function. About 4% of plasma protein comprises fibrinogen which is essential in the clotting of blood and can be converted into the insoluble protein fibrin. Other types of blood proteins include: Prealbumin, Alpha 1 antitrypsin, Alpha 1 acid glycoprotein, Alpha 1 fetoprotein, Haptoglobin, Alpha 2 macroglobulin, Ceruloplasmin, Transferrin, complement proteins C3 and C4, Beta 2 microglobulin, Beta lipoprotein, Gamma globulin proteins, C-reactive protein (CRP), Lipoproteins (chylomicrons, VLDL, LDL, HDL), other globulins (types alpha, beta and gamma), Prothrombin and Mannose-binding lectin (MBL). Any of these proteins, including classes of proteins, or derivatives thereof (such as fibrin which is derived from the cleavage of fibrinogen) can be selectively depleted from a biological sample prior to further analysis performed on the sample. Without being bound by theory, removal of such background proteins may facilitate more sensitive, accurate, or precise detection of the biomarkers of interest in the sample.

Abundant proteins in blood or blood derivatives (e.g., plasma or serum) include without limitation albumin, IgG, transferrin, fibrinogen, IgA, $\alpha_2$-Macroglobulin, IgM, $\alpha_1$-Antitrypsin, complement C3, haptoglobulin, apolipoprotein A1, apolipoprotein A3, apolipoprotein B, $\alpha_1$-Acid Glycoprotein, ceruloplasmin, complement C4, C1q, IgD, prealbumin (transthyretin), and plasminogen. Such proteins can be depleted using commercially available columns and kits. Examples of such columns comprise the Multiple Affinity Removal System from Agilent Technologies (Santa Clara, Calif.). This system include various cartridges designed to deplete different protein profiles, including the following cartridges with performance characteristics according to the manufacturer: Human 14, which eliminates approximately 94% of total protein (albumin, IgG, antitrypsin, IgA, transferrin, haptoglobin, fibrinogen, alpha2-macroglobulin, alpha1-acid glycoprotein (orosomucoid), IgM, apolipoprotein AI, apolipoprotein AII, complement C3 and transthyretin); Human 7, which eliminates approximately 85-90% of total protein (albumin, IgG, IgA, transferrin, haptoglobin, antitrypsin, and fibrinogen); Human 6, which eliminates approximately 85-90% of total protein (albumin, IgG, IgA, transferrin, haptoglobin, and antitrypsin); Human Albumin/IgG, which eliminates approximately 69% of total protein (albumin and IgG); and Human Albumin, which eliminates approximately 50-55% of total protein (albumin). The ProteoPrep® 20 Plasma Immunodepletion Kit from Sigma-Aldrich is intended to specifically remove the 20 most abundant proteins from human plasma or serum, which is about remove 97-98% of the total protein mass in plasma or serum (Sigma-Aldrich, St. Louis, Mo.). According to the manufacturer, the ProteoPrep® 20 removes: albumin, IgG, transferrin, fibrinogen, IgA, $\alpha_2$-Macroglobulin, IgM, $\alpha_1$-Antitrypsin, complement C3, haptoglobulin, apolipoprotein A1, A3 and B; $\alpha_1$-Acid Glycoprotein, ceruloplasmin, complement C4, C1q; IgD, prealbumin, and plasminogen. Sigma-Aldrich also manufactures ProteoPrep® columns to remove albumin (HSA) and immunoglobulins (IgG). The ProteomeLab IgY-12 High Capacity Proteome Partitioning kits from Beckman Coulter (Fullerton, Calif.) are specifically designed to remove twelve highly abundant proteins (Albumin, IgG, Transferrin, Fibrinogen, IgA, α2-macroglobulin, IgM, α1-Antitrypsin, Haptoglobin, Orosomucoid, Apolipoprotein A-I, Apolipoprotein A-II) from the human biological fluids such as serum and plasma. Generally, such systems rely on immunodepletion to remove the target proteins, e.g., using small ligands and/or full antibodies. The PureProteome™ Human Albumin/Immunoglobulin Depletion Kit from Millipore (EMD Millipore Corporation, Billerica, Mass., USA) is a magnetic bead based kit that enables high depletion efficiency (typically >99%) of Albumin and all Immunoglobulins (i.e., IgG, IgA, IgM, IgE and IgD) from human serum or plasma samples. The ProteoExtract® Albumin/IgG Removal Kit, also from Millipore, is designed to deplete >80% of albumin and IgG from body fluid samples. Other similar protein depletion products include without limitation the following: Aurum™ Affi-Gels Blue mini kit (Bio-Rad, Hercules, Calif., USA); Vivapure® anti-HSA/IgG kit (Sartorius Stedim Biotech, Goettingen, Germany), Qproteome albumin/IgG depletion kit (Qiagen, Hilden, Germany); Seppro® MIXED12-LC20 column (GenWay Biotech, San Diego, Calif., USA); Abundant Serum Protein Depletion Kit (Norgen Biotek Corp., Ontario, Canada); GBC Human Albumin/IgG/Transferrin 3 in 1 Depletion Column/Kit (Good Biotech Corp., Taiwan). These systems and similar systems can be used to remove abundant proteins from a biological sample, thereby improving the ability to detect low abundance circulating biomarkers such as proteins and vesicles.

Thromboplastin is a plasma protein aiding blood coagulation through conversion of prothrombin to thrombin. Thrombin in turn acts as a serine protease that converts soluble fibrinogen into insoluble strands of fibrin, as well as catalyzing many other coagulation-related reactions. Thus, thromboplastin is a protein that can be used to facilitate precipitation of fibrinogen/fibrin (blood clotting factors) out of plasma. In addition to or as an alternative to immunoaffinity protein removal, a blood sample can be treated with thromboplastin to deplete fibrinogen/fibrin. Thromboplastin removal can be performed in addition to or as an alternative to immunoaffinity protein removal as described above using methods known in the art. Precipitation of other proteins and/or other sample particulate can also improve detection of circulating biomarkers such as vesicles in a sample. For example, ammonium sulfate treatment as known in the art can be used to precipitate immunoglobulins and other highly abundant proteins.

In an embodiment, the invention provides a method of detecting a presence or level of one or more circulating biomarker such as a microvesicle in a biological sample, comprising: (a) providing a biological sample comprising or suspected to comprise the one or more circulating biomarker; (b) selectively depleting one or more abundant protein from the biological sample provided in step (a); (c) performing affinity selection of the one or more circulating biomarker from the sample depleted in step (b), thereby detecting the presence or level of one or more circulating biomarker. The biological sample may comprise a bodily fluid, e.g., peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, umbilical cord blood, or a derivative of any thereof. In some embodiments, the biological sample comprises peripheral blood, serum or plasma. Illustrative protocols and results from selectively depleting one or more abundant protein from blood plasma prior to vesicle detection can be found in Example 40 of International Patent Publication No. WO/2014/082083, filed Nov. 26, 2013, which patent publication is incorporated by reference herein in its entirety.

An abundant protein may comprise a protein in the sample that is present in the sample at a high enough concentration to potentially interfere with downstream processing or analysis. Typically, an abundant protein is not the target of any further analysis of the sample. The abundant protein may constitute at least $10^{-5}$, $10^{-4}$, $10^{-3}$, 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 96, 97, 98 or at least 99% of the total protein mass in the sample. In some embodiments, the abundant protein is present at less than $10^{-5}$% of the total protein mass in the sample, e.g., in the case of a rare target of interest. As described herein, in the case of blood or a derivative thereof, the one or more abundant protein may comprise one or more of albumin, IgG, transferrin, fibrinogen, fibrin, IgA, α2-Marcroglobulin, IgM, α1-Antitrypsin, complement C3, haptoglobulin, apolipoprotein A1, A3 and B; α1-Acid Glycoprotein, ceruloplasmin, complement C4, C1q, IgD, prealbumin (transthyretin), plasminogen, a derivative of any thereof, and a combination thereof. The one or more abundant protein in blood or a blood derivative may also comprise one or more of Albumin, Immunoglobulins, Fibrinogen, Prealbumin, Alpha 1 antitrypsin, Alpha 1 acid glycoprotein, Alpha 1 fetoprotein, Haptoglobin, Alpha 2 macroglobulin, Ceruloplasmin, Transferrin, complement proteins C3 and C4, Beta 2 microglobulin, Beta lipoprotein, Gamma globulin proteins, C-reactive protein (CRP), Lipoproteins (chylomicrons, VLDL, LDL, HDL), other globulins (types alpha, beta and gamma), Prothrombin, Mannose-binding lectin (MBL), a derivative of any thereof, and a combination thereof.

In some embodiments, selectively depleting the one or more abundant protein comprises contacting the biological sample with thromboplastin to initiate precipitation of fibrin. The one or more abundant protein may also be depleted by immunoaffinity, precipitation, or a combination thereof. For example, the sample can be treated with thromboplastin to precipitate fibrin, and then the sample may be passed through a column to remove HSA, IgG, and other abundant proteins as desired.

"Selectively depleting" the one or more abundant protein comprises depleting the abundant protein from the sample at a higher percentage than depletion another entity in the sample, such as another protein or microvesicle, including a target of interest for downstream processing or analysis. Selectively depleting the one or more abundant protein may comprise depleting the abundant protein at a 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold, $10^4$-fold, $10^5$-fold, $10^6$-fold, $10^7$-fold, $10^8$-fold, $10^9$-fold, $10^{10}$-fold, $10^{11}$-fold, $10^{12}$-fold, $10^{13}$-fold, $10^{14}$-fold, $10^{15}$-fold, $10^{16}$-fold, $10^{17}$-fold, $10^{18}$-fold, $10^{19}$-fold, $10^{20}$-fold, or higher rate than another entity in the sample, such as another protein or microvesicle, including a target of interest for downstream processing or analysis. In an embodiment, there is little to no observable depletion of the target of interest as compared to the depletion of the abundant protein. In some embodiments, selectively depleting the one or more abundant protein from the biological sample comprises depleting at least 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99% or 100% of the one or more abundant protein.

Removal of highly abundant proteins and other non-desired entities can further be facilitated with a non-stringent size exclusion step. For example, the sample can be processed using a high molecular weight cutoff size exclusion step to preferentially enrich high molecular weight vesicles apart from lower molecular weight proteins and other entities. In some embodiments, a sample is processed with a column (e.g., a gel filtration column) or filter having a molecular weight cutoff (MWCO) of 500, 600, 700, 800, 900, 1000, 1500, 2000, 2500, 3000, 3500, 4000, 4500, 5000, 5500, 6000, 6500, 7000, 7500, 8000, 8500, 9000, 9500, 10000, or greater than 10000 kiloDaltons (kDa). In an embodiment, a 700 kDa filtration column is used. In such a step, the vesicles will be retained or flow more slowly than the column or filter than the lower molecular weight entities. Such columns and filters are known in the art.

Isolation or enrichment of a vesicle from a biological sample can also be enhanced by use of sonication (for example, by applying ultrasound), detergents, other membrane-activating agents, or any combination thereof. For example, ultrasonic energy can be applied to a potential tumor site, and without being bound by theory, release of vesicles from a tissue can be increased, allowing an enriched population of vesicles that can be analyzed or assessed from a biological sample using one or more methods disclosed herein.

With methods of detecting circulating biomarkers as described here, e.g., antibody affinity isolation, the consistency of the results can be optimized as desired using various concentration or isolation procedures. Such steps can include agitation such as shaking or vortexing, different isolation techniques such as polymer based isolation, e.g., with PEG, and concentration to different levels during filtration or other steps. It will be understood by those in the art that such treatments can be applied at various stages of testing the vesicle containing sample. In one embodiment, the sample itself, e.g., a bodily fluid such as plasma or serum, is vortexed. In some embodiments, the sample is vortexed after one or more sample treatment step, e.g., vesicle isolation, has occurred. Agitation can occur at some or all appropriate sample treatment steps as desired. Additives can be introduced at the various steps to improve the process, e.g., to control aggregation or degradation of the biomarkers of interest.

The results can also be optimized as desirable by treating the sample with various agents. Such agents include additives to control aggregation and/or additives to adjust pH or ionic strength. Additives that control aggregation include blocking agents such as bovine serum albumin (BSA), milk or StabilGuard® (a BSA-free blocking agent; Product code SG02, Surmodics, Eden Prairie, Minn.), chaotropic agents such as guanidium hydro chloride, and detergents or surfactants. Useful ionic detergents include sodium dodecyl sulfate (SDS, sodium lauryl sulfate (SLS)), sodium laureth sulfate (SLS, sodium lauryl ether sulfate (SLES)), ammonium lauryl sulfate (ALS), cetrimonium bromide, cetrimonium chloride, cetrimonium stearate, and the like. Useful non-ionic (zwitterionic) detergents include polyoxyethylene glycols, polysorbate 20 (also known as Tween 20), other polysorbates (e.g., 40, 60, 65, 80, etc), Triton-X (e.g., X100, X114), 3-[(3-cholamidopropyl)dimethylammonio]-1-propanesulfonate (CHAPS), CHAPSO, deoxycholic acid, sodium deoxycholate, NP-40, glycosides, octyl-thio-glucosides, maltosides, and the like. In some embodiments, Pluronic F-68, a surfactant shown to reduce platelet aggregation, is used to treat samples containing vesicles during isolation and/or detection. F68 can be used from a 0.1% to 10% concentration, e.g., a 1%, 2.5% or 5% concentration. The pH and/or ionic strength of the solution can be adjusted with various acids, bases, buffers or salts, including without limitation sodium chloride (NaCl), phosphate-buffered saline (PBS), tris-buffered saline (TBS), sodium phosphate, potassium chloride, potassium phosphate, sodium citrate and saline-sodium citrate (SSC) buffer. In some embodiments, NaCl is added at a concentration of 0.1% to 10%, e.g., 1%, 2.5% or 5% final concentration. In some embodiments, Tween 20 is added to 0.005 to 2% concentration, e.g., 0.05%, 0.25% or 0.5% final concentration. Blocking agents for use with the invention comprise inert proteins, e.g., milk proteins, non-fat dry milk protein, albumin, BSA, casein, or serum such as newborn calf serum (NBCS), goat serum, rabbit serum or salmon serum. The proteins can be added at a 0.1% to 10% concentration, e.g., 1%, 2%, 3%, 3.5%, 4%, 5%, 6%, 7%, 8%, 9% or 10% concentration. In some embodiments, BSA is added to 0.1% to 10% concentration, e.g., 1%, 2%, 3%, 3.5%, 4%, 5%, 6%, 7%, 8%, 9% or 10% concentration. In an embodiment, the sample is treated according to the methodology presented in U.S. patent application Ser. No. 11/632,946, filed Jul. 13, 2005, which application is incorporated herein by reference in its entirety. Commercially available blockers may be used, such as SuperBlock, StartingBlock, Protein-Free from Pierce (a division of Thermo Fisher Scientific, Rockford, Ill.). In some embodiments, SSC/detergent (e.g., 20×SSC with 0.5% Tween 20 or 0.1% Triton-X 100) is added to 0.1% to 10% concentration, e.g., at 1.0% or 5.0% concentration.

The methods of detecting vesicles and other circulating biomarkers can be optimized as desired with various combinations of protocols and treatments as described herein. A detection protocol can be optimized by various combinations of agitation, isolation methods, and additives. In some embodiments, the patient sample is vortexed before and after isolation steps, and the sample is treated with blocking agents including BSA and/or F68. Such treatments may reduce the formation of large aggregates or protein or other biological debris and thus provide a more consistent detection reading.

Filtration and Ultrafiltration

A vesicle can be isolated from a biological sample by filtering a biological sample from a subject through a filtration module and collecting from the filtration module a retentate comprising the vesicle, thereby isolating the vesicle from the biological sample. The method can comprise filtering a biological sample from a subject through a filtration module comprising a filter (also referred to herein as a selection membrane); and collecting from the filtration module a retentate comprising the vesicle, thereby isolating the vesicle from the biological sample. For example, in one embodiment, the filter retains molecules greater than about 100 kiloDaltons. In such cases, microvesicles are generally found within the retentate of the filtration process whereas smaller entities such as proteins, protein complexes, nucleic acids, etc, pass through into the filtrate.

The method can be used when determining a biosignature of one or more microvesicle. The method can also further comprise contacting the retentate from the filtration to a plurality of substrates, wherein each substrate is coupled to one or more capture agents, and each subset of the plurality of substrates comprises a different capture agent or combination of capture agents than another subset of the plurality of substrates.

Also provided herein is a method of determining a biosignature of a vesicle in a sample comprising: filtering a biological sample from a subject with a disorder through a filtration module, collecting from the filtration module a retentate comprising one or more vesicles, and determining a biosignature of the one or more vesicles. In one embodiment, the filtration module comprises a filter that retains molecules greater than about 100 or 150 kiloDaltons.

The method disclosed herein can further comprise characterizing a phenotype in a subject by filtering a biological sample from a subject through a filtration module, collecting from the filtration module a retentate comprising one or more vesicles; detecting a biosignature of the one or more vesicles; and characterizing a phenotype in the subject based on the biosignature, wherein characterizing is with at least 70% sensitivity. In some embodiments, characterizing comprises determining an amount of one or more vesicle having the biosignature. Furthermore, the characterizing can be from about 80% to 100% sensitivity.

Also provided herein is a method for multiplex analysis of a plurality of vesicles. In some embodiments, the method comprises filtering a biological sample from a subject through a filtration module; collecting from the filtration module a retentate comprising the plurality of vesicles, applying the plurality of vesicles to a plurality of capture agents, wherein the plurality of capture agents is coupled to a plurality of substrates, and each subset of the plurality of substrates is differentially labeled from another subset of the plurality of substrates; capturing at least a subset of the plurality of vesicles; and determining a biosignature for at least a subset of the captured vesicles. In one embodiment, each substrate is coupled to one or more capture agents, and each subset of the plurality of substrates comprises a different capture agent or combination of capture agents as compared to another subset of the plurality of substrates. In some embodiments, at least a subset of the plurality of substrates is intrinsically labeled, such as comprising one or more labels. The substrate can be a particle or bead, or any combination thereof. In some embodiments, the filter retains molecules greater than 1, 2, 3, 4, 5, 6, 7, 8, 9, 10, 15, 20, 25, 30, 40, 50, 60, 70, 80, 90, 100, 110, 120, 130, 140, 150, 160, 170, 180, 190, 200, 250, 300, 400, 500, 600, 700, 800, 900, 1000, 1500, 2000, 2500, 3000, 3500, 4000, 4500, 5000, 5500, 6000, 6500, 7000, 7500, 8000, 8500, 9000, 9500, 10000, or greater than 10000 kiloDaltons (kDa). In one embodiment, the filtration module comprises a filter that retains molecules greater than about 100 or 150 kiloDaltons. In one embodiment, the filtration module comprises a filter that retains molecules greater than about 9, 20, 100 or 150 kiloDaltons. In still another embodiment, the filtration module comprises a filter that retains molecules greater than about 7000 kDa.

In some embodiments, the method for multiplex analysis of a plurality of vesicles comprises filtering a biological sample from a subject through a filtration module, wherein the filtration module comprises a filter that retains molecules greater than about 100 kiloDaltons; collecting from the filtration module a retentate comprising the plurality of vesicles; applying the plurality of vesicles to a plurality of capture agents, wherein the plurality of capture agents is coupled to a microarray; capturing at least a subset of the plurality of vesicles on the microarray; and determining a biosignature for at least a subset of the captured vesicles. In some embodiments, the filter retains molecules greater than 1, 2, 3, 4, 5, 6, 7, 8, 9, 10, 15, 20, 25, 30, 40, 50, 60, 70, 80, 90, 100, 110, 120, 130, 140, 150, 160, 170, 180, 190, 200, 250, 300, 400, 500, 600, 700, 800, 900, 1000, 1500, 2000, 2500, 3000, 3500, 4000, 4500, 5000, 5500, 6000, 6500, 7000, 7500, 8000, 8500, 9000, 9500, 10000, or greater than 10000 kiloDaltons (kDa). In one embodiment, the filtration module comprises a filter that retains molecules greater than about 100 or 150 kiloDaltons. In one embodiment, the filtration module comprises a filter that retains molecules greater than about 9, 20, 100 or 150 kiloDaltons. In still another embodiment, the filtration module comprises a filter that retains molecules greater than about 7000 kDa.

The biological sample can be clarified prior to isolation by filtration. Clarification comprises selective removal of cellular debris and other undesirable materials. For example, cellular debris and other components that may interfere with detection of the circulating biomarkers can be removed. The clarification can be by low-speed centrifugation, such as at about 5,000×g, 4,000×g, 3,000×g, 2,000×g, 1,000×g, or less. The supernatant, or clarified biological sample, containing the vesicle can then be collected and filtered to isolate the vesicle from the clarified biological sample. In some embodiments, the biological sample is not clarified prior to isolation of a vesicle by filtration.

In some embodiments, isolation of a vesicle from a sample does not use high-speed centrifugation, such as ultracentrifugation. For example, isolation may not require the use of centrifugal speeds, such as about 100,000×g or more. In some embodiments, isolation of a vesicle from a sample uses speeds of less than 50,000×g, 40,000×g, 30,000×g, 20,000×g, 15,000×g, 12,000×g, or 10,000×g.

Any number of applicable filter configurations can be used to filter a sample of interest. In some embodiments, the filtration module used to isolate the circulating biomarkers from the biological sample is a fiber-based filtration cartridge. For example, the fiber can be a hollow polymeric fiber, such as a polypropylene hollow fiber. A biological sample can be introduced into the filtration module by pumping the sample fluid, such as a biological fluid as disclosed herein, into the module with a pump device, such as a peristaltic pump. The pump flow rate can vary, such as at about 0.25, 0.5, 1, 1.5, 2, 2.5, 3, 3.5, 4, 4.5, 5, 6, 7, 8, 9, or 10 mL/minute. The flow rate can be adjusted given the configuration, e.g., size and throughput, of the filtration module.

The filtration module can be a membrane filtration module. For example, the membrane filtration module can comprise a filter disc membrane, such as a hydrophilic polyvinylidene difluoride (PVDF) filter disc membrane housed in a stirred cell apparatus (e.g., comprising a magnetic stirrer). In some embodiments, the sample moves through the filter as a result of a pressure gradient established on either side of the filter membrane.

The filter can comprise a material having low hydrophobic absorptivity and/or high hydrophilic properties. For example, the filter can have an average pore size for vesicle retention and permeation of most proteins as well as a surface that is hydrophilic, thereby limiting protein adsorption. For example, the filter can comprise a material selected from the group consisting of polypropylene, PVDF, polyethylene, polyfluoroethylene, cellulose, secondary cellulose acetate, polyvinylalcohol, and ethylenevinyl alcohol (EVAL®, Kuraray Co., Okayama, Japan). Additional materials that can be used in a filter include, but are not limited to, polysulfone and polyethersulfone.

The filtration module can have a filter that retains molecules greater than about 1, 2, 3, 4, 5, 6, 7, 8, 9, 10, 15, 20, 25, 30, 40, 50, 60, 70, 80, 90, 100, 110, 120, 130, 140, 150, 160, 170, 180, 190, 200, 250, 300, 400, 500, 600, 700, 800, or 900 kiloDaltons (kDa), such as a filter that has a MWCO (molecular weight cut off) of about 1, 2, 3, 4, 5, 6, 7, 8, 9, 10, 15, 20, 25, 30, 40, 50, 60, 70, 80, 90, 100, 110, 120, 130, 140, 150, 160, 170, 180, 190, 200, 250, 300, 400, 500, 600, 700, 800, or 900 kDa, respectively. In embodiments, the filtration module has a MWCO of 1000 kDa, 1500 kDa, 2000 kDa, 2500 kDa, 3000 kDa, 3500 kDa, 4000 kDa, 4500 kDa, 5000 kDa, 5500 kDa, 6000 kDa, 6500 kDa, 7000 kDa, 7500 kDa, 8000 kDa, 8500 kDa, 9000 kDa, 9500 kDa, 10000 kDa, or greater than 10000 kDa. Ultrafiltration membranes with a range of MWCO of 9 kDa, 20 kDa and/or 150 kDa can be used. In some embodiments, the filter within the filtration module has an average pore diameter of about 0.01 µm to about 0.15 µm, and in some embodiments from about 0.05 µm to about 0.12 µm. In some embodiments, the filter has an average pore diameter of about 0.06 µm, 0.07 µm, 0.08 µm, 0.09 µm, 0.1 µm, 0.11 µm or 0.2 µm.

The filtration module can be a commerically available column, such as a column typically used for concentrating proteins or for isolating proteins (e.g., ultrafiltration). Examples include, but are not limited to, columns from Millpore (Billerica, Mass.), such as Amicon® centrifugal filters, or from Pierce® (Rockford, Ill.), such as Pierce Concentrator filter devices. Useful columns from Pierce include disposable ultrafiltration centrifugal devices with a MWCO of 9 kDa, 20 kDa and/or 150 kDa. These concentrators consist of a high-performance regenerated cellulose membrane welded to a conical device. The filters can be as described in U.S. Pat. Nos. 6,269,957 or 6,357,601, both of which applications are incorporated by reference in their entirety herein.

The retentate comprising the isolated vesicle can be collected from the filtration module. The retentate can be collected by flushing the retentate from the filter. Selection of a filter composition having hydrophilic surface properties, thereby limiting protein adsorption, can be used, without being bound by theory, for easier collection of the retentate and minimize use of harsh or time-consuming collection techniques.

The collected retentate can then be used subsequent analysis, such as assessing a biosignature of one or more vesicles in the retentate, as further described herein. The analysis can be directly performed on the collected retentate. Alternatively, the collected retentate can be further concentrated or purified, prior to analysis of one or more vesicles. For example, the retentate can be further concentrated or vesicles further isolated from the retentate using size exclusion chromatography, density gradient centrifugation, differential centrifugation, immunoabsorbent capture, affinity purification, microfluidic separation, or combinations thereof, such as described herein. In some embodiments, the retentate can undergo another step of filtration. Alternatively, prior to isolation of a vesicle using a filter, the vesicle is concentrated or isolated using techniques including without limitation size exclusion chromatography, density gradient centrifugation, differential centrifugation, immunoabsorbent capture, affinity purification, microfluidic separation, or combinations thereof.

Combinations of filters can be used for concentrating and isolating biomarkers. For example, the biological sample may first be filtered through a filter having a porosity or pore size of between about 0.01 µm to about 10 µm, e.g., 0.01 µm to about 2 µm or about 0.05 µm to about 1.5 µm, and then the sample is filtered. For example, prior to filtering a biological sample through a filtration module with a filter that retains molecules greater than about 1, 2, 3, 4, 5, 6, 7, 8, 9, 10, 15, 20, 25, 30, 40, 50, 60, 70, 80, 90, 100, 110, 120, 130, 140, 150, 160, 170, 180, 190, 200, 250, 300, 400, 500, 600, 700, 800, 900, 1000, 1500, 2000, 2500, 3000, 3500, 4000, 4500, 5000, 5500, 6000, 6500, 7000, 7500, 8000, 8500, 9000, 9500, 10000, or greater than 10000 kiloDaltons (kDa), such as a filter that has a MWCO (molecular weight cut off) of about 1, 2, 3, 4, 5, 6, 7, 8, 9, 10, 15, 20, 25, 30, 40, 50, 60, 70, 80, 90, 100, 110, 120, 130, 140, 150, 160, 170, 180, 190, 200, 250, 300, 400, 500, 600, 700, 800, 900, 1000, 1500, 2000, 2500, 3000, 3500, 4000, 4500, 5000, 5500, 6000, 6500, 7000, 7500, 8000, 8500, 9000, 9500, 10000, or greater than 10000 kDa, respectively, the biological sample may first be filtered through a filter having a porosity or pore size of between about 0.01 µm to about 10 µm, e.g., 0.01 µm to about 2 µm or about 0.05 µm to about 1.5 µm. In some embodiments, the filter has a pore size of about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9 or 2.0, 3.0, 4.0, 5.0, 6.0, 7.0, 8.0, 9.0 or 10.0 µm. The filter may be a syringe filter. Thus, in one embodiment, the method comprises filtering the biological sample through a filter, such as a syringe filter, wherein the syringe filter has a porosity of greater than about 1 µm, prior to filtering the sample through a filtration module comprising a filter that retains molecules greater than about 100 or 150 kiloDaltons. In an embodiment, the filter is 1.2 µM filter and the filtration is followed by passage of the sample through a 7 ml or 20 ml concentrator column with a 150 kDa cutoff. Multiple concentrator columns may be used, e.g., in series. For example, a 7000 MWCO filtration unit can be used before a 150 MWCO unit.

The filtration module can be a component of a microfluidic device. Microfluidic devices, which may also be referred to as "lab-on-a-chip" systems, biomedical micro-electro-mechanical systems (bioMEMs), or multicomponent integrated systems, can be used for isolating, and analyzing, vesicles. Such systems miniaturize and compartmentalize processes that allow for binding of vesicles, detection of biomarkers, and other processes, such as further described herein.

The filtration module and assessment can be as described in Grant, R., et al., A filtration-based protocol to isolate human Plasma Membrane-derived Vesicles and exosomes from blood plasma, *J Immunol Methods* (2011) 371:143-51 (Epub 2011 Jun. 30), which reference is incorporated herein by reference in its entirety.

A microfluidic device can also be used for isolation of a vesicle by comprising a filtration module. For example, a microfluidic device can use one more channels for isolating a vesicle from a biological sample based on size from a biological sample. A biological sample can be introduced into one or more microfluidic channels, which selectively allows the passage of vesicles. The microfluidic device can further comprise binding agents, or more than one filtration module to select vesicles based on a property of the vesicles, for example, size, shape, deformability, biomarker profile, or biosignature.

The retentate from a filtration step can be further processed before assessment of microvesicles or other biomarkers therein. In an embodiment, the retentate is diluted prior to biomarker assessment, e.g., with an appropriate diluent such as a biologically compatible buffer. In some cases, the retentate is serially diluted. In an aspect, the invention provides a method for detecting a microvesicle population from a biological sample comprising: a) concentrating the biological sample using a selection membrane having a pore size of from 0.01 µm to about 10 µm, or a molecular weight cut off (MWCO) from about 1 kDa to 10000 kDa; b) diluting a retentate from the concentration step into one or more aliquots; and c) contacting each of the one or more aliquots of retentate with one or more binding agent specific to a molecule of at least one microvesicle in the microvesicle population. In a related aspect, the invention provides a method for detecting a microvesicle population from a biological sample comprising: a) concentrating the biological sample using a selection membrane having a pore size of from 0.01 µm to about 10 µm, or a molecular weight cut off (MWCO) from about 1 kDa to 10000 kDa; and b) contacting one or more aliquots of the retentate from the concentrating step with one or more binding agent specific to a molecule of at least one microvesicle in the microvesicle population.

The selection membrane can be sized to retain the desired biomarkers in the retentate or to allow the desired biomarkers to pass through the filter into the filtrate. The filter membrane can be chosen to have a certain pore size or MWCO value. The selection membrane can have a pore size of about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9 or 2.0, 3.0, 4.0, 5.0, 6.0, 7.0, 8.0, 9.0 or 10.0 µm. The selection membrane can also have a MWCO of about 1, 2, 3, 4, 5, 6, 7, 8, 9, 10, 15, 20, 25, 30, 40, 50, 60, 70, 80, 90, 100, 110, 120, 130, 140, 150, 160, 170, 180, 190, 200, 250, 300, 400, 500, 600, 700, 800, 900, 1000, 2000, 3000, 4000, 5000, 6000, 7000, 8000, 9000 or 10000 kDa.

The retentate can be separated and/or diluted into any number of desired aliquots. For example, multiple aliquots without any dilution or the same dilution can be used to determine reproducibility. In another example, multiple aliquots at different dilutions can be used to construct a concentration curve. In an embodiment, the retentate is separated and/or diluted into at least 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250, 300, 350 or 400 aliquots. The aliquots can be at a same dilution or at different dilutions.

A dilution factor is the ratio of the final volume of a mixture (the mixture of the diluents and aliquot) divided by the initial volume of the aliquot. The retentate can be diluted into one or more aliquots at a dilution factor of about 0, 1, 2, 3, 4, 5, 6, 7, 8, 9, 10, 15, 20, 25, 30, 40, 50, 60, 70, 80, 90, 100, 110, 120, 130, 140, 150, 160, 170, 180, 190, 200, 250, 300, 400, 500, 600, 700, 800, 900, 1000, 1500, 2000, 2500, 3000, 3500, 4000, 4500, 5000, 5500, 6000, 6500, 7000, 7500, 8000, 8500, 9000, 9500, 10000, 20000, 30000, 40000, 50000, 60000, 70000, 80000, 90000 and/or 100000. For example, the retentate can be diluted into one or more aliquot at a dilution factor of about 500.

To estimate a concentration or form a curve, the retentate can be diluted into multiple aliquots. In an embodiment of the method, the retentate is diluted into one or more aliquots at a dilution factor of about 100, 250, 500, 1000, 10000 and 100000. As desired, the method can further comprise detecting an amount of microvesicles in each aliquot of retentate, e.g., that formed a complex with the one or more binding agent. The curve can be used to determine a linear range of the amount of microvesicles in each aliquot detected versus dilution factor. A concentration of the detected microvesicles for the biological sample can be determined using the amount of microvesicles determined in one or more aliquot within the linear range. The concentration can be compared to a reference concentration, e.g., in order to characterize a phenotype as described herein.

The invention also provides a related method comprising filtering a biological sample from a subject through a filtration module and collecting a filtrate comprising the vesicle, thereby isolating the vesicle from the biological sample. In such cases cells and other large entities can be retained in the retentate while microvesicles pass through into the filtrate. It will be appreciated that strategies to retain and filter microvesicles can be used in concert. For example, a sample can be filtered with a selection membrane that allows microvesicles to pass through, thereby isolating the microvesicles from large particles (cells, complexes, etc). The filtrate comprising the microvesicle can then be filtered using a selection membrane that retains microvesicles, thereby isolating the microvesicles from smaller particles (proteins, nucleic acids, etc). The isolated microvesicles can be further assessed according to the methods of the invention, e.g., to characterize a phenotype.

Precipitation

Vesicles can be isolated using a polymeric precipitation method. The method can be in combination with or in place of the other isolation methods described herein. In one embodiment, the sample containing the vesicles is contacted with a formulation of polyethylene glycol (PEG). The polymeric formulation is incubated with the vesicle containing sample then precipitated by centrifugation. The PEG can bind to the vesicles and can be treated to specifically capture vesicles by addition of a capture moiety, e.g., a pegylated-binding protein such as an antibody. One of skill will appreciate that other polymers in addition to PEG can be used, e.g., PEG derivatives including methoxypolyethylene glycols, poly (ethylene oxide), and various polymers of formula $HO-CH_2-(CH_2-O-CH_2-)n-CH_2-OH$ having different molecular weights. The efficiency of isolation may depend on various factors including the length of the polymer chains and concentration of polymer used. In preferred embodiments, PEG4000 or PEG 8000 may be used at a concentration of 1%, 2%, 3%, 4%, 5%, 6%, 7%, 8%, 9%, or 10%, e.g., 4% or 8%.

In some embodiments of the invention, the vesicles are concentrated from a sample using the polymer precipitation method and the isolated vesicles are further separated using another approach. The second step can be used to identify a subpopulation of vesicles, e.g., that display certain biomarkers. The second separation step can comprise size exclusion, a binding agent, an antibody capture step, microbeads, as described herein.

In an embodiment, vesicles are isolated according to the ExoQuick™ and ExoQuick-TC™ kits from System Biosciences, Mountain View, Calif. USA. These kits use a polymer-based precipitation method to pellet vesicles. Similarly, the vesicles can be isolated using the Total Exosome Isolation (from Serum) or Total Exosome Isolation (from Cell Culture Media) kits from Invitrogen/Life Technologies (Carlsbad, Calif. USA). The Total Exosome Isolation reagent forces less-soluble components such as vesicles out of solution, allowing them to be collected by a short, low-speed centrifugation. The reagent is added to the biological sample, and the solution is incubated overnight at 2° C. to 8° C. The precipitated vesicles are recovered by standard centrifugation.

Binding Agents

Binding agents (also referred to as binding reagents) include agents that are capable of binding a target biomarker. A binding agent can be specific for the target biomarker, meaning the agent is capable of binding a target biomarker. The target can be any useful biomarker disclosed herein, such as a biomarker on the vesicle surface. In some embodiments, the target is a single molecule, such as a single protein, so that the binding agent is specific to the single protein. In other embodiments, the target can be a group of molecules, such as a family or proteins having a similar epitope or moiety, so that the binding agent is specific to the family or group of proteins. The group of molecules can also be a class of molecules, such as protein, DNA or RNA. The binding agent can be a capture agent used to capture a vesicle by binding a component or biomarker of a vesicle. In some embodiments, a capture agent comprises an antibody or fragment thereof, or an aptamer, that binds to an antigen on a vesicle. The capture agent can be optionally coupled to a substrate and used to isolate a vesicle, as further described herein.

A binding agent is an agent that binds to a circulating biomarker, such as a vesicle or a component of a vesicle. The binding agent can be used as a capture agent and/or a detection agent. A capture agent can bind and capture a circulating biomarker, such as by binding a component or biomarker of a vesicle. For example, the capture agent can be a capture antibody or capture antigen that binds to an antigen on a vesicle. A detection agent can bind to a circulating biomarker thereby facilitating detection of the biomarker. For example, a capture agent comprising an antibody or aptamer that is sequestered to a substrate can be used to capture a vesicle in a sample, and a detection agent comprising an antibody or aptamer that carries a label can be used to detect the captured vesicle via detection of the detection agent's label. In some embodiments, a vesicle is assessed using capture and detection agents that recognize the same vesicle biomarkers. For example, a vesicle population can be captured using a tetraspanin such as by using an anti-CD9 antibody bound to a substrate, and the captured vesicles can be detected using a fluorescently labeled anti-CD9 antibody to label the captured vesicles. In other embodiments, a vesicle is assessed using capture and detection agents that recognize different vesicle biomarkers. For example, a vesicle population can be captured using a cell-specific marker such as by using an anti-PCSA antibody bound to a substrate, and the captured vesicles can be detected using a fluorescently labeled anti-CD9 antibody to label the captured vesicles. Similarly, the vesicle population can be captured using a general vesicle marker such as by using an anti-CD9 antibody bound to a substrate, and the captured vesicles can be detected using a fluorescently labeled antibody to a cell-specific or disease specific marker to label the captured vesicles.

The biomarkers recognized by the binding agent are sometimes referred to herein as an antigen. Unless otherwise specified, antigen as used herein is meant to encompass any entity that is capable of being bound by a binding agent, regardless of the type of binding agent or the immunogenicity of the biomarker. The antigen further encompasses a functional fragment thereof. For example, an antigen can encompass a protein biomarker capable of being bound by a binding agent, including a fragment of the protein that is capable of being bound by a binding agent.

In one embodiment, a vesicle is captured using a capture agent that binds to a biomarker on a vesicle. The capture agent can be coupled to a substrate and used to isolate a vesicle, as further described herein. In one embodiment, a capture agent is used for affinity capture or isolation of a vesicle present in a substance or sample.

A binding agent can be used after a vesicle is concentrated or isolated from a biological sample. For example, a vesicle can first be isolated from a biological sample before a vesicle with a specific biosignature is isolated or detected. The vesicle with a specific biosignature can be isolated or detected using a binding agent for the biomarker. A vesicle with the specific biomarker can be isolated or detected from a heterogeneous population of vesicles. Alternatively, a binding agent may be used on a biological sample comprising vesicles without a prior isolation or concentration step. For example, a binding agent is used to isolate or detect a vesicle with a specific biosignature directly from a biological sample.

A binding agent can be a nucleic acid, protein, or other molecule that can bind to a component of a vesicle. The binding agent can comprise DNA, RNA, monoclonal antibodies, polyclonal antibodies, Fabs, Fab', single chain antibodies, synthetic antibodies, aptamers (DNA/RNA), peptoids, zDNA, peptide nucleic acids (PNAs), locked nucleic acids (LNAs), lectins, synthetic or naturally occurring chemical compounds (including but not limited to drugs, labeling reagents), dendrimers, or a combination thereof. For example, the binding agent can be a capture antibody. In embodiments of the invention, the binding agent comprises a membrane protein labeling agent. See, e.g., the membrane protein labeling agents disclosed in Alroy et al., US. Patent Publication US 2005/0158708. In an embodiment, vesicles are isolated or captured as described herein, and one or more membrane protein labeling agent is used to detect the vesicles.

In some instances, a single binding agent can be employed to isolate or detect a vesicle. In other instances, a combination of different binding agents may be employed to isolate or detect a vesicle. For example, at least 2, 3, 4, 5, 6, 7, 8, 9, 10, 11, 12, 13, 14, 15, 16, 17, 18, 19, 20, 25, 50, 75 or 100 different binding agents may be used to isolate or detect a vesicle from a biological sample. Furthermore, the one or more different binding agents for a vesicle can form a biosignature of a vesicle, as further described below.

Different binding agents can also be used for multiplexing. For example, isolation or detection of more than one population of vesicles can be performed by isolating or detecting each vesicle population with a different binding agent. Different binding agents can be bound to different particles, wherein the different particles are labeled. In another embodiment, an array comprising different binding agents can be used for multiplex analysis, wherein the different binding agents are differentially labeled or can be ascertained based on the location of the binding agent on the array. Multiplexing can be accomplished up to the resolution capability of the labels or detection method, such as described below. The binding agents can be used to detect the vesicles, such as for detecting cell-of-origin specific vesicles. A binding agent or multiple binding agents can themselves form a binding agent profile that provides a biosignature for a vesicle. One or more binding agents can be selected from FIG. 2 of International Patent Publication No. WO/2011/127219, entitled "Circulating Biomarkers for Disease" and filed Apr. 6, 2011, which application is incorporated by reference in its entirety herein. For example, if a vesicle population is detected or isolated using two, three, four or more binding agents in a differential detection or isolation of a vesicle from a heterogeneous population of vesicles, the particular binding agent profile for the vesicle population provides a biosignature for the particular vesicle population. The vesicle can be detected using any number of binding agents in a multiplex fashion. Thus, the binding agent can also be used to form a biosignature for a vesicle. The biosignature can be used to characterize a phenotype.

The binding agent can be a lectin. Lectins are proteins that bind selectively to polysaccharides and glycoproteins and are widely distributed in plants and animals. For example, lectins such as those derived from Galanthus nivalis in the form of Galanthus nivalis agglutinin ("GNA"), Narcissus pseudonarcissus in the form of Narcissus pseudonarcissus agglutinin ("NPA") and the blue green algae Nostoc ellipsosporum called "cyanovirin" (Boyd et al. *Antimicrob Agents Chemother* 41(7): 1521 1530, 1997; Hamman et al. *Ann N Y Acad Sci* 724: 166169, 1994; Kaku et al. *Arch Biochem Biophys* 279(2): 298 304, 1990) can be used to isolate a vesicle. These lectins can bind to glycoproteins having a high mannose content (Chervenak et al. *Biochemistry* 34(16): 5685 5695, 1995). High mannose glycoprotein refers to glycoproteins having mannose-mannose linkages in the form of $\alpha$-1$\to$3 or $\alpha$-1$\to$6 mannose-mannose linkages.

The binding agent can be an agent that binds one or more lectins. Lectin capture can be applied to the isolation of the biomarker cathepsin D since it is a glycosylated protein capable of binding the lectins Galanthus nivalis agglutinin (GNA) and concanavalin A (ConA).

Methods and devices for using lectins to capture vesicles are described in International Patent Publications WO/2011/066589, entitled "METHODS AND SYSTEMS FOR ISOLATING, STORING, AND ANALYZING VESICLES" and filed Nov. 30, 2010; WO/2010/065765, entitled "AFFINITY CAPTURE OF CIRCULATING BIOMARKERS" and filed Dec. 3, 2009; WO/2010/141862, entitled "METHODS AND MATERIALS FOR ISOLATING EXOSOMES" and filed Jun. 4, 2010; and WO/2007/103572, entitled "EXTRACORPOREAL REMOVAL OF MICROVESICULAR PARTICLES" and filed Mar. 9, 2007, each of which applications is incorporated by reference herein in its entirety.

The binding agent can be an antibody. For example, a vesicle may be isolated using one or more antibodies specific for one or more antigens present on the vesicle. For example, a vesicle can have CD63 on its surface, and an antibody, or capture antibody, for CD63 can be used to isolate the vesicle. Alternatively, a vesicle derived from a tumor cell can express EpCam, the vesicle can be isolated using an antibody for EpCam and CD63. Other antibodies for isolating vesicles can include an antibody, or capture antibody, to CD9, PSCA, TNFR, CD63, B7H3, MFG-E8, EpCam, Rab, CD81, STEAP, PCSA, PSMA, or 5T4. Other antibodies for isolating vesicles can include an antibody, or capture antibody, to DR3, STEAP, epha2, TMEM211, MFG-E8, Tissue Factor (TF), unc93A, A33, CD24, NGAL, EpCam, MUC17, TROP2, or TETS.

In some embodiments, the capture agent is an antibody to CD9, CD63, CD81, PSMA, PCSA, B7H3, EpCam, PSCA, ICAM, STEAP, or EGFR. The capture agent can also be used to identify a biomarker of a vesicle. For example, a capture agent such as an antibody to CD9 would identify CD9 as a biomarker of the vesicle. In some embodiments, a plurality of capture agents can be used, such as in multiplex analysis. The plurality of captures agents can comprise binding agents to one or more of: CD9, CD63, CD81, PSMA, PCSA, B7H3, EpCam, PSCA, ICAM, STEAP, and EGFR. In some embodiments, the plurality of capture agents comprise binding agents to CD9, CD63, CD81, PSMA, PCSA, B7H3, MFG-E8, and/or EpCam. In yet other embodiments, the plurality of capture agents comprises binding agents to CD9, CD63, CD81, PSMA, PCSA, B7H3, EpCam, PSCA, ICAM, STEAP, and/or EGFR. The plurality of capture agents comprises binding agents to TMEM211, MFG-E8, Tissue Factor (TF), and/or CD24.

The antibodies referenced herein can be immunoglobulin molecules or immunologically active portions of immunoglobulin molecules, i.e., molecules that contain an antigen binding site that specifically binds an antigen and synthetic antibodies. The immunoglobulin molecules can be of any class (e.g., IgG, IgE, IgM, IgD or IgA) or subclass of immunoglobulin molecule. Antibodies include, but are not limited to, polyclonal, monoclonal, bispecific, synthetic, humanized and chimeric antibodies, single chain antibodies, Fab fragments and F(ab')$_2$ fragments, Fv or Fv' portions, fragments produced by a Fab expression library, anti-idiotypic (anti-Id) antibodies, or epitope-binding fragments of any of the above. An antibody, or generally any molecule, "binds specifically" to an antigen (or other molecule) if the antibody binds preferentially to the antigen, and, e.g., has less than about 30%, 20%, 10%, 5% or 1% cross-reactivity with another molecule.

The binding agent can also be a polypeptide or peptide. Polypeptide is used in its broadest sense and may include a sequence of subunit amino acids, amino acid analogs, or peptidomimetics. The subunits may be linked by peptide bonds. The polypeptides may be naturally occurring, processed forms of naturally occurring polypeptides (such as by enzymatic digestion), chemically synthesized or recombinantly expressed. The polypeptides for use in the methods of the present invention may be chemically synthesized using standard techniques. The polypeptides may comprise D-amino acids (which are resistant to L-amino acid-specific proteases), a combination of D- and L-amino acids, β amino acids, or various other designer or non-naturally occurring amino acids (e.g., β-methyl amino acids, Cα-methyl amino acids, and Nα-methyl amino acids, etc.) to convey special properties. Synthetic amino acids may include ornithine for lysine, and norleucine for leucine or isoleucine. In addition, the polypeptides can have peptidomimetic bonds, such as ester bonds, to prepare polypeptides with novel properties. For example, a polypeptide may be generated that incorporates a reduced peptide bond, i.e., $R_1$—$CH_2$—$NH$—$R_2$, where $R_1$ and $R_2$ are amino acid residues or sequences. A reduced peptide bond may be introduced as a dipeptide subunit. Such a polypeptide would be resistant to protease activity, and would possess an extended half-live in vivo. Polypeptides can also include peptoids (N-substituted glycines), in which the side chains are appended to nitrogen atoms along the molecule's backbone, rather than to the α-carbons, as in amino acids. Polypeptides and peptides are intended to be used interchangeably throughout this application, i.e. where the term peptide is used, it may also include polypeptides and where the term polypeptides is used, it may also include peptides. The term "protein" is also intended to be used interchangeably throughout this application with the terms "polypeptides" and "peptides" unless otherwise specified.

A vesicle may be isolated, captured or detected using a binding agent. The binding agent can be an agent that binds a vesicle "housekeeping protein," or general vesicle biomarker. The biomarker can be CD63, CD9, CD81, CD82, CD37, CD53, Rab-5b, Annexin V, MFG-E8 or other commonly observed vesicle markers include those listed in Table 3. Furthermore, any of the markers disclosed herein or in Table 3 can be selected in identifying a candidate biosignature for a disease or condition, where the one or more selected biomarkers have a direct or indirect role or function in mechanisms involved in the disease or condition.

The binding agent can also be an agent that binds to a vesicle derived from a specific cell type, such as a tumor cell (e.g. binding agent for Tissue factor, EpCam, B7H3, RAGE or CD24) or a specific cell-of-origin. The binding agent used to isolate or detect a vesicle can be a binding agent for an antigen selected from FIG. 1 of International Patent Publication No. WO/2011/127219, entitled "Circulating Biomarkers for Disease" and filed Apr. 6, 2011, which application is incorporated by reference in its entirety herein. The binding agent for a vesicle can also be selected from those listed in FIG. 2 of International Patent Publication No. WO/2011/127219. The binding agent can be for an antigen such as a tetraspanin, MFG-E8, Annexin V, 5T4, B7H3, caveolin, CD63, CD9, E-Cadherin, Tissue factor, MFG-E8, TMEM211, CD24, PSCA, PCSA, PSMA, Rab-5B, STEAP, TNFR1, CD81, EpCam, CD59, CD81, ICAM, EGFR, or CD66. A binding agent for a platelet can be a glycoprotein such as GpIa-IIa, GpIIb-IIIa, GpIIIb, GpIb, or GpIX. A binding agent can be for an antigen comprisine one or more of CD9, Erb2, Erb4, CD81, Erb3, MUC16, CD63, DLL4, HLA-Drpe, B7H3, IFNAR, 5T4, PCSA, MICB, PSMA, MFG-E8, Muc1, PSA, Muc2, Unc93a, VEGFR2, EpCAM, VEGF A, TMPRSS2, RAGE, PSCA, CD40, Muc17, IL-17-RA, and CD80. For example, the binding agent can be one or more of CD9, CD63, CD81, B7H3, PCSA, MFG-E8, MUC2, EpCam, RAGE and Muc17. One or more binding agents, such as one or more binding agents for two or more of the antigens, can be used for isolating or detecting a vesicle. The binding agent used can be selected based on the desire of isolating or detecting a vesicle derived from a particular cell type or cell-of-origin specific vesicle. The binding agent can be to one or more vesicle marker in Table 4.

A binding agent can also be linked directly or indirectly to a solid surface or substrate. A solid surface or substrate can be any physically separable solid to which a binding agent can be directly or indirectly attached including, but not limited to, surfaces provided by microarrays and wells, particles such as beads, columns, optical fibers, wipes, glass and modified or functionalized glass, quartz, mica, diazotized membranes (paper or nylon), polyformaldehyde, cellulose, cellulose acetate, paper, ceramics, metals, metalloids, semiconductive materials, quantum dots, coated beads or particles, other chromatographic materials, magnetic particles; plastics (including acrylics, polystyrene, copolymers of styrene or other materials, polypropylene, polyethylene, polybutylene, polyurethanes, polytetrafluoroethylene (PTFE, Teflon®), etc.), polysaccharides, nylon or nitrocellulose, resins, silica or silica-based materials including silicon and modified silicon, carbon, metals, inorganic glasses, plastics, ceramics, conducting polymers (including polymers such as polypyrole and polyindole); micro or nanostructured surfaces such as nucleic acid tiling arrays, nanotube, nanowire, or nanoparticulate decorated surfaces; or porous surfaces or gels such as methacrylates, acrylamides, sugar polymers, cellulose, silicates, or other fibrous or stranded polymers. In addition, as is known the art, the substrate may be coated using passive or chemically-derivatized coatings with any number of materials, including polymers, such as dextrans, acrylamides, gelatins or agarose. Such coatings can facilitate the use of the array with a biological sample.

For example, an antibody used to isolate a vesicle can be bound to a solid substrate such as a well, such as commercially available plates (e.g. from Nunc, Milan Italy). Each well can be coated with the antibody. In some embodiments, the antibody used to isolate a vesicle is bound to a solid substrate such as an array. The array can have a predetermined spatial arrangement of molecule interactions, binding islands, biomolecules, zones, domains or spatial arrangements of binding islands or binding agents deposited within discrete boundaries. Further, the term array may be used herein to refer to multiple arrays arranged on a surface, such as would be the case where a surface bore multiple copies of an array. Such surfaces bearing multiple arrays may also be referred to as multiple arrays or repeating arrays.

Arrays typically contain addressable moieties that can detect the presence of an entity, e.g., a vesicle in the sample via a binding event. An array may be referred to as a microarray. Arrays or microarrays include without limitation DNA microarrays, such as cDNA microarrays, oligonucleotide microarrays and SNP microarrays, microRNA arrays, protein microarrays, antibody microarrays, tissue microarrays, cellular microarrays (also called transfection microarrays), chemical compound microarrays, and carbohydrate arrays (glycoarrays). DNA arrays typically comprise addressable nucleotide sequences that can bind to sequences present in a sample. MicroRNA arrays, e.g., the MMChips array from the University of Louisville or commercial systems from Agilent, can be used to detect microRNAs. Protein microarrays can be used to identify protein-protein interactions, including without limitation identifying substrates of protein kinases, transcription factor protein-activation, or to identify the targets of biologically active small molecules. Protein arrays may comprise an array of different protein molecules, commonly antibodies, or nucleotide sequences that bind to proteins of interest. In a non-limiting example, a protein array can be used to detect vesicles having certain proteins on their surface. Antibody arrays comprise antibodies spotted onto the protein chip that are used as capture molecules to detect proteins or other biological materials from a sample, e.g., from cell or tissue lysate solutions. For example, antibody arrays can be used to detect vesicle-associated biomarkers from bodily fluids, e.g., serum or urine. Tissue microarrays comprise separate tissue cores assembled in array fashion to allow multiplex histological analysis. Cellular microarrays, also called transfection microarrays, comprise various capture agents, such as antibodies, proteins, or lipids, which can interact with cells to facilitate their capture on addressable locations. Cellular arrays can also be used to capture vesicles due to the similarity between a vesicle and cellular membrane. Chemical compound microarrays comprise arrays of chemical compounds and can be used to detect protein or other biological materials that bind the compounds. Carbohydrate arrays (glycoarrays) comprise arrays of carbohydrates and can detect, e.g., protein that bind sugar moieties. One of skill will appreciate that similar technologies or improvements can be used according to the methods of the invention.

A binding agent can also be bound to particles such as beads or microspheres. For example, an antibody specific for a component of a vesicle can be bound to a particle, and the antibody-bound particle is used to isolate a vesicle from a biological sample. In some embodiments, the microspheres may be magnetic or fluorescently labeled. In addition, a binding agent for isolating vesicles can be a solid substrate itself. For example, latex beads, such as aldehyde/sulfate beads (Interfacial Dynamics, Portland, Oreg.) can be used.

A binding agent bound to a magnetic bead can also be used to isolate a vesicle. For example, a biological sample such as serum from a patient can be collected for colon cancer screening. The sample can be incubated with anti-CCSA-3 (Colon Cancer-Specific Antigen) coupled to magnetic microbeads. A low-density microcolumn can be placed in the magnetic field of a MACS Separator and the column is then washed with a buffer solution such as Tris-buffered saline. The magnetic immune complexes can then be applied to the column and unbound, non-specific material can be discarded. The CCSA-3 selected vesicle can be recovered by removing the column from the separator and placing it on a collection tube. A buffer can be added to the column and the magnetically labeled vesicle can be released by applying the plunger supplied with the column. The isolated vesicle can be diluted in IgG elution buffer and the complex can then be centrifuged to separate the microbeads from the vesicle. The pelleted isolated cell-of-origin specific vesicle can be resuspended in buffer such as phosphate-buffered saline and quantitated. Alternatively, due to the strong adhesion force between the antibody captured cell-of-origin specific vesicle and the magnetic microbeads, a proteolytic enzyme such as trypsin can be used for the release of captured vesicles without the need for centrifugation. The proteolytic enzyme can be incubated with the antibody captured cell-of-origin specific vesicles for at least a time sufficient to release the vesicles.

A binding agent, such as an antibody, for isolating vesicles is preferably contacted with the biological sample comprising the vesicles of interest for at least a time sufficient for the binding agent to bind to a component of the vesicle. For example, an antibody may be contacted with a biological sample for various intervals ranging from seconds days, including but not limited to, about 10 minutes, 30 minutes, 1 hour, 3 hours, 5 hours, 7 hours, 10 hours, 15 hours, 1 day, 3 days, 7 days or 10 days.

A binding agent, such as an antibody specific to an antigen listed in FIG. 1 of International Patent Publication No. WO/2011/127219, entitled "Circulating Biomarkers for Disease" and filed Apr. 6, 2011, which application is incorporated by reference in its entirety herein, or a binding agent listed in FIG. 2 of International Patent Publication No. WO/2011/127219, can be labeled to facilitate detection. Appropriate labels include without limitation a magnetic label, a fluorescent moiety, an enzyme, a chemiluminescent probe, a metal particle, a non-metal colloidal particle, a polymeric dye particle, a pigment molecule, a pigment particle, an electrochemically active species, semiconductor nanocrystal or other nanoparticles including quantum dots or gold particles, fluorophores, quantum dots, or radioactive labels. Various protein, radioactive, fluorescent, enzymatic, and other labels are described further above.

A binding agent can be directly or indirectly labeled, e.g., the label is attached to the antibody through biotin-streptavidin. Alternatively, an antibody is not labeled, but is later contacted with a second antibody that is labeled after the first antibody is bound to an antigen of interest.

Depending on the method of isolation or detection used, the binding agent may be linked to a solid surface or substrate, such as arrays, particles, wells and other substrates described above. Methods for direct chemical coupling of antibodies, to the cell surface are known in the art, and may include, for example, coupling using glutaraldehyde or maleimide activated antibodies. Methods for chemical coupling using multiple step procedures include biotinylation, coupling of trinitrophenol (TNP) or digoxigenin using for example succinimide esters of these compounds. Biotinylation can be accomplished by, for example, the use of D-biotinyl-N-hydroxysuccinimide. Succinimide groups react effectively with amino groups at pH values above 7, and preferentially between about pH 8.0 and about pH 8.5. Biotinylation can be accomplished by, for example, treating the cells with dithiothreitol followed by the addition of biotin maleimide.

Particle-Based Assays

As an alternative to planar arrays, assays using particles or microspheres, such as bead based assays, are capable of use with a binding agent. For example, antibodies or aptamers are easily conjugated with commercially available beads. See, e.g., Fan et al., Illumina universal bead arrays. Methods Enzymol. 2006 410:57-73; Srinivas et al. Anal. Chem. 2011 Oct. 21, *Aptamer functionalized Microgel Particles for Protein Detection*; See also, review article on aptamers as therapeutic and diagnostic agents, Brody and Gold, Rev. Mol. Biotech. 2000, 74:5-13.

Multiparametric assays or other high throughput detection assays using bead coatings with cognate ligands and reporter molecules with specific activities consistent with high sensitivity automation can be used. In a bead based assay system, a binding agent for a biomarker or vesicle, such as a capture agent (e.g. capture antibody), can be immobilized on an addressable microsphere. Each binding agent for each individual binding assay can be coupled to a distinct type of microsphere (i.e., microbead) and the assay reaction takes place on the surface of the microsphere, such as depicted in FIG. 2B. A binding agent for a vesicle can be a capture antibody or aptamer coupled to a bead. Dyed microspheres with discrete fluorescence intensities are loaded separately with their appropriate binding agent or capture probes. The different bead sets carrying different binding agents can be pooled as desired to generate custom bead arrays. Bead arrays are then incubated with the sample in a single reaction vessel to perform the assay.

Various particle/bead substrates and systems useful for the methods of the invention are described further above.

Flow Cytometry

In various embodiments of the invention, flow cytometry, which is described in further detail above, is used to assess a microvesicle population in a biological sample. If desired, the microvesicle population can be sorted from other particles (e.g., cell debris, protein aggregates, etc) in a sample by labeling the vesicles using one or more general vesicle marker. The general vesicle marker can be a marker in Table 3. Commonly used vesicle markers include tetraspanins such as CD9, CD63 and/or CD81. Vesicles comprising one or more tetraspanin are sometimes referred to as "Tet+" herein to indicate that the vesicles are tetraspanin-positive.

The sorted microvesicles can be further assessed using methodology described herein. E.g., surface antigens on the sorted microvesicles can be detected using flow or other methods. In some embodiments, payload within the sorted microvesicles is assessed. As an illustrative example, a population of microvesicles is contacted with a labeled binding agent to a surface antigen of interest, the contacted microvesicles are sorted using flow cytometry, and payload with the microvesicles is assessed. The payload may be polypeptides, nucleic acids (e.g., mRNA or microRNA) or other biological entities as desired. Such assessment is used to characterize a phenotype as described herein, e.g., to diagnose, prognose or theranose a cancer.

In an embodiment, flow sorting is used to distinguish microvesicle populations from other biological complexes. In a non-limiting example, Ago2+/Tet+ and Ago2+/Tet– particles are detected using flow methodology to separate Ago2+ vesicles from vesicle-free Ago2+ complexes, respectively.

Multiplexing

Multiplex experiments comprise experiments that can simultaneously measure multiple analytes in a single assay. Vesicles and associated biomarkers can be assessed in a multiplex fashion. Different binding agents can be used for multiplexing different circulating biomarkers, e.g., microRNA, protein, or vesicle populations. Different biomarkers, e.g., different vesicle populations, can be isolated or detected using different binding agents. Each population in a biological sample can be labeled with a different signaling label, such as a fluorophore, quantum dot, or radioactive label, such as described above. The label can be directly conjugated to a binding agent or indirectly used to detect a binding agent that binds a vesicle. The number of populations detected in a multiplexing assay is dependent on the resolution capability of the labels and the summation of signals, as more than two differentially labeled vesicle populations that bind two or more affinity elements can produce summed signals.

Multiplexing of at least 2, 3, 4, 5, 6, 7, 8, 9, 10, 11, 12, 13, 14, 15, 16, 17, 18, 19, 20, 25, 50, 75 or 100 different circulating biomarkers may be performed. For example, one population of vesicles specific to a cell-of-origin can be assayed along with a second population of vesicles specific to a different cell-of-origin, where each population is labeled with a different label. Alternatively, a population of vesicles with a particular biomarker or biosignature can be assayed along with a second population of vesicles with a different biomarker or biosignature. In some cases, hundreds or thousands of vesicles are assessed in a single assay.

In one embodiment, multiplex analysis is performed by applying a plurality of vesicles comprising more than one population of vesicles to a plurality of substrates, such as beads. Each bead is coupled to one or more capture agents. The plurality of beads is divided into subsets, where beads with the same capture agent or combination of capture agents form a subset of beads, such that each subset of beads has a different capture agent or combination of capture agents than another subset of beads. The beads can then be used to capture vesicles that comprise a component that binds to the capture agent. The different subsets can be used to capture different populations of vesicles. The captured vesicles can then be analyzed by detecting one or more biomarkers.

Flow cytometry can be used in combination with a particle-based or bead based assay. Multiparametric immunoassays or other high throughput detection assays using bead coatings with cognate ligands and reporter molecules with specific activities consistent with high sensitivity automation can be used. For example, beads in each subset can be differentially labeled from another subset. In a particle based assay system, a binding agent or capture agent for a vesicle, such as a capture antibody, can be immobilized on addressable beads or microspheres. Each binding agent for each individual binding assay (such as an immunoassay when the binding agent is an antibody) can be coupled to a distinct type of microsphere (i.e., microbead) and the binding assay reaction takes place on the surface of the microspheres. Microspheres can be distinguished by different labels, for example, a microsphere with a specific capture agent would have a different signaling label as compared to another microsphere with a different capture agent. For example, microspheres can be dyed with discrete fluorescence intensities such that the fluorescence intensity of a microsphere with a specific binding agent is different than that of another microsphere with a different binding agent. Biomarkers bound by different capture agents can be differentially detected using different labels.

A microsphere can be labeled or dyed with at least 2 different labels or dyes. In some embodiments, the microsphere is labeled with at least 3, 4, 5, 6, 7, 8, 9, or 10 different labels. Different microspheres in a plurality of microspheres can have more than one label or dye, wherein various subsets of the microspheres have various ratios and combinations of the labels or dyes permitting detection of different microspheres with different binding agents. For example, the various ratios and combinations of labels and dyes can permit different fluorescent intensities. Alternatively, the various ratios and combinations maybe used to generate different detection patters to identify the binding agent. The microspheres can be labeled or dyed externally or may have intrinsic fluorescence or signaling labels. Beads can be loaded separately with their appropriate binding agents and thus, different vesicle populations can be isolated based on the different binding agents on the differentially labeled microspheres to which the different binding agents are coupled.

In another embodiment, multiplex analysis can be performed using a planar substrate, wherein the substrate comprises a plurality of capture agents. The plurality of capture agents can capture one or more populations of vesicles, and one or more biomarkers of the captured vesicles detected. The planar substrate can be a microarray or other substrate as further described herein.

Binding Agents

A vesicle may be isolated or detected using a binding agent for a novel component of a vesicle, such as an antibody for a novel antigen specific to a vesicle of interest. Novel antigens that are specific to a vesicle of interest may be isolated or identified using different test compounds of known composition bound to a substrate, such as an array or a plurality of particles, which can allow a large amount of chemical/structural space to be adequately sampled using only a small fraction of the space. The novel antigen identified can also serve as a biomarker for the vesicle. For example, a novel antigen identified for a cell-of-origin specific vesicle can be a useful biomarker.

The term "agent" or "reagent" as used in respect to contacting a sample can mean any entity designed to bind, hybridize, associate with or otherwise detect or facilitate detection of a target molecule, including target polypeptides, peptides, nucleic acid molecules, leptins, lipids, or any other biological entity that can be detected as described herein or as known in the art. Examples of such agents/reagents are well known in the art, and include but are not limited to universal or specific nucleic acid primers, nucleic acid probes, antibodies, aptamers, peptoid, peptide nucleic acid, locked nucleic acid, lectin, dendrimer, chemical compound, or other entities described herein or known in the art.

A binding agent can be identified by screening either a homogeneous or heterogeneous vesicle population against test compounds. Since the composition of each test compound on the substrate surface is known, this constitutes a screen for affinity elements. For example, a test compound array comprises test compounds at specific locations on the substrate addressable locations, and can be used to identify one or more binding agents for a vesicle. The test compounds can all be unrelated or related based on minor variations of a core sequence or structure. The different test compounds may include variants of a given test compound (such as polypeptide isoforms), test compounds that are structurally or compositionally unrelated, or a combination thereof.

A test compound can be a peptoid, polysaccharide, organic compound, inorganic compound, polymer, lipids, nucleic acid, polypeptide, antibody, protein, polysaccharide, or other compound. The test compound can be natural or synthetic. The test compound can comprise or consist of linear or branched heteropolymeric compounds based on any of a number of linkages or combinations of linkages (e.g., amide, ester, ether, thiol, radical additions, metal coordination, etc.), dendritic structures, circular structures, cavity structures or other structures with multiple nearby sites of attachment that serve as scaffolds upon which specific additions are made. These test compound can be spotted on a substrate or synthesized in situ, using standard methods in the art. In addition, the test compound can be spotted or synthesized in situ in combinations in order to detect useful interactions, such as cooperative binding.

The test compound can be a polypeptide with known amino acid sequence, thus, detection of a test compound binding with a vesicle can lead to identification of a polypeptide of known amino sequence that can be used as a binding agent. For example, a homogenous population of vesicles can be applied to a spotted array on a slide containing between a few and 1,000,000 test polypeptides having a length of variable amino acids. The polypeptides can be attached to the surface through the C-terminus. The sequence of the polypeptides can be generated randomly from 19 amino acids, excluding cysteine. The binding reaction can include a non-specific competitor, such as excess bacterial proteins labeled with another dye such that the specificity ratio for each polypeptide binding target can be determined. The polypeptides with the highest specificity and binding can be selected. The identity of the polypeptide on each spot is known, and thus can be readily identified. Once the novel antigens specific to the homogeneous vesicle population, such as a cell-of-origin specific vesicle is identified, such cell-of-origin specific vesicles may subsequently be isolated using such antigens in methods described hereafter.

An array can also be used for identifying an antibody as a binding agent for a vesicle. Test antibodies can be attached to an array and screened against a heterogeneous population of vesicles to identify antibodies that can be used to isolate or identify a vesicle. A homogeneous population of vesicles such as cell-of-origin specific vesicles can also be screened with an antibody array. Other than identifying antibodies to isolate or detect a homogeneous population of vesicles, one or more protein biomarkers specific to the homogenous population can be identified. Commercially available platforms with test antibodies pre-selected or custom selection of test antibodies attached to the array can be used. For example, an antibody array from Full Moon Biosystems can be screened using prostate cancer cell derived vesicles identifying antibodies to Bcl-XL, ERCC1, Keratin 15, CD81/TAPA-1, CD9, Epithelial Specific Antigen (ESA), and Mast Cell Chymase as binding agents, and the proteins identified can be used as biomarkers for the vesicles. The biomarker can be present or absent, underexpressed or overexpressed, mutated, or modified in or on a vesicle and used in characterizing a condition.

An antibody or synthetic antibody to be used as a binding agent can also be identified through a peptide array. Another method is the use of synthetic antibody generation through antibody phage display. M13 bacteriophage libraries of antibodies (e.g. Fabs) are displayed on the surfaces of phage particles as fusions to a coat protein. Each phage particle displays a unique antibody and also encapsulates a vector that contains the encoding DNA. Highly diverse libraries can be constructed and represented as phage pools, which can be used in antibody selection for binding to immobilized antigens. Antigen-binding phages are retained by the immobilized antigen, and the nonbinding phages are removed by washing. The retained phage pool can be amplified by infection of an *Escherichia coli* host and the amplified pool can be used for additional rounds of selection to eventually obtain a population that is dominated by antigen-binding clones. At this stage, individual phase clones can be isolated and subjected to DNA sequencing to decode the sequences of the displayed antibodies. Through the use of phase display and other methods known in the art, high affinity designer antibodies for vesicles can be generated.

Bead-based assays can also be used to identify novel binding agents to isolate or detect a vesicle. A test antibody or peptide can be conjugated to a particle. For example, a bead can be conjugated to an antibody or peptide and used to detect and quantify the proteins expressed on the surface of a population of vesicles in order to discover and specifically select for novel antibodies that can target vesicles from specific tissue or tumor types. Any molecule of organic origin can be successfully conjugated to a polystyrene bead through use of a commercially available kit according to manufacturer's instructions. Each bead set can be colored a certain detectable wavelength and each can be linked to a known antibody or peptide which can be used to specifically measure which beads are linked to exosomal proteins matching the epitope of previously conjugated antibodies or peptides. The beads can be dyed with discrete fluorescence intensities such that each bead with a different intensity has a different binding agent as described above.

For example, a purified vesicle preparation can be diluted in assay buffer to an appropriate concentration according to empirically determined dynamic range of assay. A sufficient volume of coupled beads can be prepared and approximately 1 µl of the antibody-coupled beads can be aliquoted into a well and adjusted to a final volume of approximately 50 µl. Once the antibody-conjugated beads have been added to a vacuum compatible plate, the beads can be washed to ensure proper binding conditions. An appropriate volume of vesicle preparation can then be added to each well being tested and the mixture incubated, such as for 15-18 hours. A sufficient volume of detection antibodies using detection antibody diluent solution can be prepared and incubated with the mixture for 1 hour or more. The beads can then be washed before the addition of detection antibody (biotin expressing) mixture composed of streptavidin phycoereythin. The beads can then be washed and vacuum aspirated several times before analysis on a suspension array system using software provided with an instrument. The identity of antigens that can be used to selectively extract the vesicles can then be elucidated from the analysis.

Assays using imaging systems can be used to detect and quantify proteins expressed on the surface of a vesicle in order to discover and specifically select for and enrich vesicles from specific tissue, cell or tumor types. Antibodies, peptides or cells conjugated to multiple well multiplex carbon coated plates can be used. Simultaneous measurement of many analytes in a well can be achieved through the use of capture antibodies arrayed on the patterned carbon working surface. Analytes can then be detected with antibodies labeled with reagents in electrode wells with an enhanced electro-chemiluminescent plate. Any molecule of organic origin can be successfully conjugated to the carbon coated plate. Proteins expressed on the surface of vesicles can be identified from this assay and can be used as targets to specifically select for and enrich vesicles from specific tissue or tumor types.

The binding agent can also be an aptamer to a specific target. The term "specific" as used herein in regards to a binding agent can mean that an agent has a greater affinity for its target than other targets, typically with a much great affinity, but does not require that the binding agent is absolutely specific for its target.

Microfluidics

The methods for isolating or identifying vesicles can be used in combination with microfluidic devices. The methods of isolating or detecting a vesicle, such as described herein, can be performed using a microfluidic device. Microfluidic devices, which may also be referred to as "lab-on-a-chip" systems, biomedical micro-electro-mechanical systems (bioMEMs), or multicomponent integrated systems, can be used for isolating and analyzing a vesicle. Such systems miniaturize and compartmentalize processes that allow for binding of vesicles, detection of biosignatures, and other processes.

A microfluidic device can also be used for isolation of a vesicle through size differential or affinity selection. For example, a microfluidic device can use one more channels for isolating a vesicle from a biological sample based on size or by using one or more binding agents for isolating a vesicle from a biological sample. A biological sample can be introduced into one or more microfluidic channels, which selectively allows the passage of a vesicle. The selection can be based on a property of the vesicle, such as the size, shape, deformability, or biosignature of the vesicle.

In one embodiment, a heterogeneous population of vesicles can be introduced into a microfluidic device, and one or more different homogeneous populations of vesicles can be obtained. For example, different channels can have different size selections or binding agents to select for different vesicle populations. Thus, a microfluidic device can isolate a plurality of vesicles wherein at least a subset of the plurality of vesicles comprises a different biosignature from another subset of the plurality of vesicles. For example, the microfluidic device can isolate at least 2, 3, 4, 5, 6, 7, 8, 9, 10, 15, 20, 25, 30, 40, 50, 60, 70, 80, 90, or 100 different subsets of vesicles, wherein each subset of vesicles comprises a different biosignature.

In some embodiments, the microfluidic device can comprise one or more channels that permit further enrichment or selection of a vesicle. A population of vesicles that has been enriched after passage through a first channel can be introduced into a second channel, which allows the passage of the desired vesicle or vesicle population to be further enriched, such as through one or more binding agents present in the second channel.

Array-based assays and bead-based assays can be used with microfluidic device. For example, the binding agent can be coupled to beads and the binding reaction between the beads and vesicle can be performed in a microfluidic device. Multiplexing can also be performed using a microfluidic device. Different compartments can comprise different binding agents for different populations of vesicles, where each population is of a different cell-of-origin specific vesicle population. In one embodiment, each population has a different biosignature. The hybridization reaction between the microsphere and vesicle can be performed in a microfluidic device and the reaction mixture can be delivered to a detection device. The detection device, such as a dual or multiple laser detection system can be part of the microfluidic system and can use a laser to identify each bead or microsphere by its color-coding, and another laser can detect the hybridization signal associated with each bead.

Various microfluidic devices and methods are described above.

Combined Isolation Methodology

One of skill will appreciate that various methods of sample treatment and isolating and concentrating circulating biomarkers such as vesicles can be combined as desired. For example, a biological sample can be treated to prevent aggregation, remove undesired particulate and/or deplete highly abundant proteins. The steps used can be chosen to optimize downstream analysis steps. Next, biomarkers such as vesicles can be isolated, e.g., by chromotography, centrifugation, density gradient, filtration, precipitation, or affinity techniques. Any number of the later steps can be combined, e.g., a sample could be subjected to one or more of chromotography, centrifugation, density gradient, filtration and precipitation in order to isolate or concentrate all or most microvesicles. In a subsequent step, affinity techniques, e.g., using binding agents to one or more target of interest, can be used to isolate or identify microvesicles carrying desired biomarker profiles. Microfluidic systems can be employed to perform some or all of these steps.

An exemplary yet non-limiting isolation scheme for isolating and analysis of microvesicles includes the following: Plasma or serum collection→highly abundant protein removal→ultrafiltration→nanomembrane concentration→flow cytometry or particle-based assay.

Using the methods disclosed herein or known in the art, circulating biomarkers such as vesicles can be isolated or concentrated by at least about 2-fold, 3-fold, 1-fold, 2-fold, 3-fold, 4-fold, 5-fold, 6-fold, 7-fold, 8-fold, 9-fold, 10-fold, 12-fold, 15-fold, 20-fold, 25-fold, 30-fold, 35-fold, 40-fold, 45-fold, 50-fold, 55-fold, 60-fold, 65-fold, 70-fold, 75-fold, 80-fold, 90-fold, 95-fold, 100-fold, 110-fold, 120-fold, 125-fold, 130-fold, 140-fold, 150-fold, 160-fold, 170-fold, 175-fold, 180-fold, 190-fold, 200-fold, 205-fold, 250-fold, 275-fold, 300-fold, 325-fold, 350-fold, 375-fold, 400-fold, 425-fold, 450-fold, 475-fold, 500-fold, 525-fold, 550-fold, 575-fold, 600-fold, 625-fold, 650-fold, 675-fold, 700-fold, 725-fold, 750-fold, 775-fold, 800-fold, 825-fold, 850-fold, 875-fold, 900-fold, 925-fold, 950-fold, 975-fold, 1000-fold, 1500-fold, 2000-fold, 2500-fold, 3000-fold, 4000-fold, 5000-fold, 6000-fold, 7000-fold, 8000-fold, 9000-fold, or at least 10,000-fold. In some embodiments, the vesicles are isolated or concentrated concentrated by at least 1 order of magnitude, 2 orders of magnitude, 3 orders of magnitude, 4 orders of magnitude, 5 orders of magnitude, 6 orders of magnitude, 7 orders of magnitude, 8 orders of magnitude, 9 orders of magnitude, or 10 orders of magnitude or more.

Once concentrated or isolated, the circulating biomarkers can be assessed, e.g., in order to characterize a phenotype as described herein. In some embodiments, the concentration or isolation steps themselves shed light on the phenotype of interest. For example, affinity methods can detect the presence or level of specific biomarkers of interest.

The various isolation and detection systems described herein can be used to isolate or detect circulating biomarkers such as vesicles that are informative for diagnosis, prognosis, disease stratification, theranosis, prediction of responder/non-responder status, disease monitoring, treatment monitoring and the like as related to such diseases and disorders. Combinations of the isolation techniques are within the scope of the invention. In a non-limiting example, a sample can be run through a chromatography column to isolate vesicles based on a property such as size of electrophoretic motility, and the vesicles can then be passed through a microfluidic device. Binding agents can be used before, during or after these steps.

The methods and compositions of the invention can be used with microvesicles isolated or detected using such methods as described herein. In various non-limiting examples: an aptamer provided by the methods of the invention can be used as a capture and/or detector agent for a biomarker such as a protein or microvesicle; a sample such as a bodily fluid can be contacted with an oligonucleotide probe library of the invention before microvesicles in the sample are isolated using one or more technique described herein (e.g., chromatography, centrifugation, flow cytometry, filtration, affinity isolation, polymer precipitation, etc); microvesicles in a sample are isolated using one or more technique described herein (e.g., chromatography, centrifugation, flow cytometry, filtration, affinity isolation, polymer precipitation, etc) before contacting the microvesicles with an aptamer or oligonucleotide probe library of the invention. Contaminants such as highly abundant proteins can be removed in whole or in part at any appropriate step in such processes. These and various other useful iterations of such techniques for assessment of microvesicles and other biomarkers are contemplated by the invention.

Biomarkers

As described herein, the methods and compositions of the invention can be used in assays to detect the presence or level of one or more biomarker of interest. The biomarker can be any useful biomarker disclosed herein or known to those of skill in the art. In an embodiment, the biomarker comprises a protein or polypeptide. As used herein, "protein," "polypeptide" and "peptide" are used interchangeably unless stated otherwise. The biomarker can be a nucleic acid, including DNA, RNA, and various subspecies of any thereof as disclosed herein or known in the art. The biomarker can comprise a lipid. The biomarker can comprise a carbohydrate. The biomarker can also be a complex, e.g., a complex comprising protein, nucleic acids, lipids and/or carbohydrates. In some embodiments, the biomarker comprises a microvesicle. In an embodiment, the invention provides a method wherein a pool of aptamers is used to assess the presence and/or level of a population of microvesicles of interest without knowing the precise microvesicle antigen targeted by each member of the pool. See, e.g., FIGS. 19B-C. In other cases, biomarkers associated with microvesicles are assessed according to the methods of the invention. See, e.g., FIGS. 2A-F; FIG. 19A.

A biosignature comprising more than one biomarker can comprise one type of biomarker or multiple types of biomarkers. As a non-limiting example, a biosignature can comprise multiple proteins, multiple nucleic acids, multiple lipids, multiple carbohydrates, multiple biomarker complexes, multiple microvesicles, or a combination of any thereof. For example, the biosignature may comprise one or more microvesicle, one or more protein, and one or more microRNA, wherein the one or more protein and/or one or more microRNA is optionally in association with the microvesicle as a surface antigen and/or payload, as appropriate.

In some embodiments, vesicles are detected using vesicle surface antigens. A commonly expressed vesicle surface antigen can be referred to as a "housekeeping protein," or general vesicle biomarker. The biomarker can be CD63, CD9, CD81, CD82, CD37, CD53, Rab-5b, Annexin V or MFG-E8. Tetraspanins, a family of membrane proteins with four transmembrane domains, can be used as general vesicle biomarkers. The tetraspanins include CD151, CD53, CD37, CD82, CD81, CD9 and CD63. There have been over 30 tetraspanins identified in mammals, including the TSPAN1 (TSP-1), TSPAN2 (TSP-2), TSPAN3 (TSP-3), TSPAN4 (TSP-4, NAG-2), TSPAN5 (TSP-5), TSPAN6 (TSP-6), TSPAN7 (CD231, TALLA-1, A15), TSPAN8 (CO-029), TSPAN9 (NET-5), TSPAN10 (Oculospanin), TSPAN11 (CD151-like), TSPAN12 (NET-2), TSPAN13 (NET-6), TSPAN14, TSPAN15 (NET-7), TSPAN16 (TM4-B), TSPAN17, TSPAN18, TSPAN19, TSPAN20 (UP1b, UPK1B), TSPAN21 (UP1a, UPK1A), TSPAN22 (RDS, PRPH2), TSPAN23 (ROM1), TSPAN24 (CD151), TSPAN25 (CD53), TSPAN26 (CD37), TSPAN27 (CD82), TSPAN28 (CD81), TSPAN29 (CD9), TSPAN30 (CD63), TSPAN31 (SAS), TSPAN32 (TSSC6), TSPAN33, and TSPAN34. Other commonly observed vesicle markers include those listed in Table 3. One or more of these proteins can be useful biomarkers for the characterizing a phenotype using the subject methods and compositions.

TABLE 3

Proteins Observed in Vesicles from Multiple Cell Types

| Class | Protein |
| --- | --- |
| Antigen Presentation | MHC class I, MHC class II, Integrins, Alpha 4 beta 1, Alpha M beta 2, Beta 2 |
| Immunoglobulin family | ICAM1/CD54, P-selection |
| Cell-surface peptidases | Dipeptidylpeptidase IV/CD26, Aminopeptidase n/CD13 |
| Tetraspanins | CD151, CD53, CD37, CD82, CD81, CD9 and CD63 |
| Heat-shock proteins | Hsp70, Hsp84/90 |
| Cytoskeletal proteins | Actin, Actin-binding proteins, Tubulin |
| Membrane transport and fusion | Annexin I, Annexin II, Annexin IV, Annexin V, Annexin VI, RAB7/RAP1B/RADGDI |
| Signal transduction | Gi2alpha/14-3-3, CBL/LCK |
| Abundant membrane proteins | CD63, GAPDH, CD9, CD81, ANXA2, ENO1, SDCBP, MSN, MFGE8, EZR, GK, ANXA1, LAMP2, DPP4, TSG101, HSPA1A, GDI2, CLTC, LAMP1, Cd86, ANPEP, TFRC, SLC3A2, RDX, RAP1B, RAB5C, RAB5B, MYH9, ICAM1, FN1, RAB11B, PIGR, LGALS3, ITGB1, EHD1, CLIC1, ATP1A1, ARF1, RAP1A, P4HB, MUC1, KRT10, HLA-A, FLOT1, CD59, C1orf58, BASP1, TACSTD1, STOM |
| Other Transmembrane Proteins | Cadherins: CDH1, CDH2, CDH12, CDH3, Deomoglein, DSG1, DSG2, DSG3, DSG4, Desmocollin, DSC1, DSC2, DSC3, Protocadherins, PCDH1, PCDH10, PCDH11x, PCDH11y, PCDH12, FAT, FAT2, FAT4, PCDH15, PCDH17, PCDH18, PCDH19; PCDH20; PCDH7, PCDH8, PCDH9, PCDHA1, PCDHA10, PCDHA11, PCDHA12, PCDHA13, PCDHA2, PCDHA3, PCDHA4, PCDHA5, PCDHA6, PCDHA7, PCDHA8, PCDHA9, PCDHAC1, PCDHAC2, PCDHB1, PCDHB10, PCDHB11, PCDHB12, PCDHB13, PCDHB14, PCDHB15, PCDHB16, PCDHB17, PCDHB18, PCDHB2, PCDHB3, PCDHB4, PCDHB5, PCDHB6, PCDHB7, PCDHB8, PCDHB9, PCDHGA1, PCDHGA10, PCDHGA11, PCDHGA12, PCDHGA2; PCDHGA3, PCDHGA4, PCDHGA5, PCDHGA6, PCDHGA7, PCDHGA8, PCDHGA9, PCDHGB1, PCDHGB2, PCDHGB3, PCDHGB4, PCDHGB5, PCDHGB6, PCDHGB7, PCDHGC3, PCDHGC4, PCDHGC5, CDH9 (cadherin 9, type 2 (T1-cadherin)), CDH10 (cadherin 10, type 2 (T2-cadherin)), CDH5 (VE-cadherin (vascular endothelial)), CDH6 (K-cadherin (kidney)), CDH7 (cadherin 7, type 2), CDH8 (cadherin 8, type 2), CDH11 (OB-cadherin (osteoblast)), CDH13 (T-cadherin - H-cadherin (heart)), CDH15 (M-cadherin (myotubule)), CDH16 (KSP-cadherin), CDH17 (LI cadherin (liver-intestine)), CDH18 (cadherin 18, type 2), CDH19 (cadherin 19, type 2), CDH20 (cadherin 20, type 2), CDH23 (cadherin 23, (neurosensory epithelium)), CDH10, CDH11, CDH13, CDH15, CDH16, CDH17, CDH18, CDH19, CDH20, CDH22, CDH23, CDH24, CDH26, CDH28, CDH4, CDH5, CDH6, CDH7, CDH8, CDH9, CELSR1, CELSR2, CELSR3, CLSTN1, CLSTN2, CLSTN3, DCHS1, DCHS2, LOC389118, PCLKC, RESDA1, RET |

Any of the types of biomarkers or specific biomarkers described herein can be used and/or assessed via the subject methods and compositions, e.g., to identify a useful biosignature. Exemplary biomarkers include without limitation those in Table 4. The markers can be detected as protein, RNA or DNA as appropriate, which can be circulating freely or in a complex with other biological molecules. As appropriate, the markers in Table 4 can also be used for capture and/or detection of vesicles for characterizing phenotypes as disclosed herein. In some cases, multiple capture and/or detectors are used to enhance the characterization. The markers can be detected as protein or as mRNA, which can be circulating freely or in a complex with other biological molecules. See, e.g., FIGS. 2D-E. The markers can be detected as vesicle surface antigens and/or vesicle payload.

The "Illustrative Class" indicates indications for which the markers are known markers. Those of skill will appreciate that the markers can also be used in alternate settings in certain instances. For example, a marker which can be used to characterize one type disease may also be used to characterize another disease as appropriate. Consider a non-limiting example of a tumor marker which can be used as a biomarker for tumors from various lineages. The biomarker references in Tables 3 and 4 are those commonly used in the art. Gene aliases and descriptions can be found using a variety of online databases, including GeneCards® (www.genecards.org), HUGO Gene Nomenclature (www.genenames.org), Entrez Gene (www.ncbi.nlm.nih.gov/entrez/query.fcgi?db=gene), UniProtKB/Swiss-Prot (www.uniprot.org), UniProtKB/TrEMBL (www.uniprot.org), OMIM (www.ncbi.nlm.nih.gov/entrez/query.fcgi?db=OMIM), GeneLoc (genecards.weizmann.ac.il/geneloc/), and Ensembl (www.ensembl.org). Generally, gene symbols and names below correspond to those approved by HUGO, and protein names are those recommended by UniProtKB/Swiss-Prot. Common alternatives are provided as well. In some cases, biomarkers are referred to by Ensembl reference numbers, which are of the form "ENSG" followed by a number, e.g., ENSG00000005893 which corresponds to LAMP2. In Table 4, solely for sake of brevity, "E." is sometimes used to represent "ENSG00000". For example, "E.005893 represents "ENSG00000005893." Where a protein name indicates a precursor, the mature protein is also implied. Throughout the application, gene and protein symbols may be used interchangeably and the meaning can be derived from context as necessary.

TABLE 4

Illustrative Biomarkers

| Illustrative Class | Biomarkers |
| --- | --- |
| Drug associated targets and prognostic markers | ABCC1, ABCG2, ACE2, ADA, ADH1C, ADH4, AGT, AR, AREG, ASNS, BCL2, BCRP, BDCA1, beta III tubulin, BIRC5, B-RAF, BRCA1, BRCA2, CA2, caveolin, CD20, CD25, CD33, CD52, CDA, CDKN2A, CDKN1A, CDKN1B, CDK2, CDW52, CES2, CK 14, CK 17, CK 5/6, c-KIT, c-Met, c-Myc, COX-2, Cyclin D1, DCK, DHFR, DNMT1, DNMT3A, DNMT3B, E-Cadherin, ECGF1, EGFR, EML4-ALK fusion, EPHA2, Epiregulin, ER, ERBR2, ERCC1, ERCC3, EREG, ESR1, FLT1, folate receptor, FOLR1, FOLR2, FSHB, FSHPRH1, FSHR, FYN, GART, GNA11, GNAQ, GNRH1, GNRHR1, GSTP1, HCK, HDAC1, hENT-1, Her2/Neu, HGF, HIF1A, HIG1, HSP90, HSP90AA1, HSPCA, IGF-1R, IGFRBP, IGFRBP3, IGFRBP4, IGFRBP5, IL13RA1, IL2RA, KDR, Ki67, KIT, K-RAS, LCK, LTB, Lymphotoxin Beta Receptor, LYN, MET, MGMT, MLH1, MMR, MRP1, MS4A1, MSH2, MSH5, Myc, NFKB1, NFKB2, NFKBIA, NRAS, ODC1, OGFR, p16, p21, p27, p53, p95, PARP-1, PDGFC, PDGFR, PDGFRA, PDGFRB, PGP, PGR, PI3K, POLA, POLA1, PPARG, PPARGC1, PR, PTEN, PTGS2, PTPN12, RAF1, RARA, ROS1, RRM1, RRM2, RRM2B, RXRB, RXRG, SIK2, SPARC, SRC, SSTR1, SSTR2, SSTR3, SSTR4, SSTR5, Survivin, TK1, TLE3, TNF, TOP1, TOP2A, TOP2B, TS, TUBB3, TXN, TXNRD1, TYMS, VDR, VEGF, VEGFA, VEGFC, VHL, YES1, ZAP70 |
| Drug associated targets and prognostic markers | ABL1, STK11, FGFR2, ERBB4, SMARCB1, CDKN2A, CTNNB1, FGFR1, FLT3, NOTCH1, NPM1, SRC, SMAD4, FBXW7, PTEN, TP53, AKT1, ALK, APC, CDH1, C-Met, HRAS, IDH1, JAK2, MPL, PDGFRA, SMO, VHL, ATM, CSF1R, FGFR3, GNAS, ERBB2, HNF1A, JAK3, KDR, MLH1, PTPN11, RB1, RET, c-Kit, EGFR, PIK3CA, NRAS, GNA11, GNAQ, KRAS, BRAF |
| Drug associated targets and prognostic markers | ALK, AR, BRAF, cKIT, cMET, EGFR, ER, ERCC1, GNA11, HER2, IDH1, KRAS, MGMT, MGMT promoter methylation, NRAS, PDGFRA, Pgp, PIK3CA, PR, PTEN, ROS1, RRM1, SPARC, TLE3, TOP2A, TOPO1, TS, TUBB3, VHL |
| Drug associated targets | ABL1, AKT1, ALK, APC, AR, ATM, BRAF, BRAF, BRCA1, BRCA2, CDH1, cKIT, cMET, CSF1R, CTNNB1, EGFR, EGFR (H-score), EGFRvIII, ER, ERBB2 (HER2), ERBB4, ERCC1, FBXW7, FGFR1, FGFR2, FLT3, GNA11, GNAQ, GNAS, HER2, HNF1A, HRAS, IDH1, IDH2, JAK2, JAK3, KDR (VEGFR2), KRAS, MGMT, MGMT Promoter Methylation, microsatellite instability (MSI), MLH1, MPL, MSH2, MSH6, NOTCH1, NPM1, NRAS, PD-1, PDGFRA, PD-L1, Pgp, PIK3CA, PMS2, PR, PTEN, PTPN11, RB1, RET, ROS1, RRM1, SMAD4, SMARCB1, SMO, SPARC, STK11, TLE3, TOP2A, TOPO1, TP53, TS, TUBB3, VHL |
| Drug associated targets | 1p19q co-deletion, ABL1, AKT1, ALK, APC, AR, ARAF, ATM, BAP1, BRAF, BRCA1, BRCA2, CDH1, CHEK1, CHEK2, cKIT, cMET, CSF1R, CTNNB1, DDR2, EGFR, EGFRvIII, ER, ERBB2 (HER2), ERBB3, ERBB4, ERCC1, FBXW7, FGFR1, FGFR2, FLT3, GNA11, GNAQ, GNAS, H3K36me3, HER2, HNF1A, HRAS, IDH1, IDH2, JAK2, JAK3, KDR (VEGFR2), KRAS, MDMT, MGMT, MGMT Methylation, Microsatellite instability, MLH1, MPL, MSH2, MSH6, NF1, NOTCH1, NPM1, NRAS, NY-ESO-1, PD-1, PDGFRA, PD-L1, Pgp, PIK3CA, PMS2, PR, PTEN, PTPN11, RAF1, RB1, RET, ROS1, ROS1, RRM1, SMAD4, SMARCB1, SMO, SPARC, STK11, TLE3, TOP2A, TOPO1, TP53, TRKA, TS, TUBB3, VHL, WT1 |
| Drug associated targets | ABL1, AKT1, ALK, APC, AR, ATM, BRAF, BRAF, BRCA1, BRCA2, CDH1, cKIT, cMET, CSF1R, CTNNB1, EGFR, EGFR (H-score), EGFRvIII, ER, ERBB2 (HER2), ERBB4, ERCC1, FBXW7, FGFR1, FGFR2, FLT3, GNA11, GNAQ, GNAS, HER2, HNF1A, HRAS, IDH1, IDH2, JAK2, JAK3, KDR (VEGFR2), KRAS, MGMT, MGMT Promoter Methylation, microsatellite instability (MSI), MLH1, MPL, MSH2, MSH6, NOTCH1, NPM1, NRAS, PD-1, PDGFRA, PD-L1, Pgp, PIK3CA, PMS2, PR, PTEN, PTPN11, RB1, RET, ROS1, RRM1, SMAD4, SMARCB1, SMO, SPARC, STK11, TLE3, TOP2A, TOPO1, TP53, TS, TUBB3, VHL |
| Drug associated targets | 1p19q, ALK, ALK (2p23), Androgen Receptor, BRCA, cMET, EGFR, EGFR, EGFRvIII, ER, ERCC1, Her2, Her2/Neu, MGMT, MGMT Promoter Methylation, microsatellite instability (MSI), MLH1, MSH2, MSH6, PD-1, PD-L1, PMS2, PR, PTEN, ROS1, RRM1, TLE3, TOP2A, TOP2A, TOPO1, TS, TUBB3 |

TABLE 4-continued

Illustrative Biomarkers

| Illustrative Class | Biomarkers |
|---|---|
| Drug associated targets | TOP2A, Chromosome 17 alteration, PBRM1 (PB1/BAF180), BAP1, SETD2 (ANTI-HISTONE H3), MDM2, Chromosome 12 alteration, ALK, CTLA4, CD3, NY-ESO-1, MAGE-A, TP, EGFR |
| 5-aminosalicyclic acid (5-ASA) efficacy | μ-protocadherin, KLF4, CEBPα |
| Cancer treatment associated markers | AR, AREG (Amphiregulin), BRAF, BRCA1, cKIT, cMET, EGFR, EGFR w/T790M, EML4-ALK, ER, ERBB3, ERBB4, ERCC1, EREG, GNA11, GNAQ, hENT-1, Her2, Her2 Exon 20 insert, IGF1R, Ki67, KRAS, MGMT, MGMT methylation, MSH2, MSI, NRAS, PGP (MDR1), PIK3CA, PR, PTEN, ROS1, ROS1 translocation, RRM1, SPARC, TLE3, TOPO1, TOPO2A, TS, TUBB3, VEGFR2 |
| Cancer treatment associated markers | AR, AREG, BRAF, BRCA1, cKIT, cMET, EGFR, EGFR w/T790M, EML4-ALK, ER, ERBB3, ERBB4, ERCC1, EREG, GNA11, GNAQ, Her2, Her2 Exon 20 insert, IGFR1, Ki67, KRAS, MGMT-Me, MSH2, MSI, NRAS, PGP (MDR-1), PIK3CA, PR, PTEN, ROS1 translocation, RRM1, SPARC, TLE3, TOPO1, TOPO2A, TS, TUBB3, VEGFR2 |
| Colon cancer treatment associated markers | AREG, BRAF, EGFR, EML4-ALK, ERCC1, EREG, KRAS, MSI, NRAS, PIK3CA, PTEN, TS, VEGFR2 |
| Colon cancer treatment associated markers | AREG, BRAF, EGFR, EML4-ALK, ERCC1, EREG, KRAS, MSI, NRAS, PIK3CA, PTEN, TS, VEGFR2 |
| Melanoma treatment associated markers | BRAF, cKIT, ERBB3, ERBB4, ERCC1, GNA11, GNAQ, MGMT, MGMT methylation, NRAS, PIK3CA, TUBB3, VEGFR2 |
| Melanoma treatment associated markers | BRAF, cKIT, ERBB3, ERBB4, ERCC1, GNA11, GNAQ, MGMT-Me, NRAS, PIK3CA, TUBB3, VEGFR2 |
| Ovarian cancer treatment associated markers | BRCA1, cMET, EML4-ALK, ER, ERBB3, ERCC1, hENT-1, HER2, IGF1R, PGP(MDR1), PIK3CA, PR, PTEN, RRM1, TLE3, TOPO1, TOPO2A, TS |
| Ovarian cancer treatment associated markers | BRCA1, cMET, EML4-ALK (translocation), ER, ERBB3, ERCC1, HER2, PIK3CA, PR, PTEN, RRM1, TLE3, TS |
| Breast cancer treatment associated markers | BRAF, BRCA1, EGFR, EGFR T790M, EML4-ALK, ER, ERBB3, ERCC1, HER2, Ki67, PGP (MDR1), PIK3CA, PR, PTEN, ROS1, ROS1 translocation, RRM1, TLE3, TOPO1, TOPO2A, TS |
| Breast cancer treatment associated markers | BRAF, BRCA1, EGFR w/T790M, EML4-ALK, ER, ERBB3, ERCC1, HER2, Ki67, KRAS, PIK3CA, PR, PTEN, ROS1 translocation, RRM1, TLE3, TOPO1, TOPO2A, TS |
| NSCLC cancer treatment associated markers | BRAF, BRCA1, cMET, EGFR, EGFR w/T790M, EML4-ALK, ERCC1, Her2 Exon 20 insert, KRAS, MSH2, PIK3CA, PTEN, ROS1 (trans), RRM1, TLE3, TS, VEGFR2 |
| NSCLC cancer treatment associated markers | BRAF, cMET, EGFR, EGFR w/T790M, EML4-ALK, ERCC1, Her2 Exon 20 insert, KRAS, MSH2, PIK3CA, PTEN, ROS1 translocation, RRM1, TLE3, TS |
| Mutated in cancers | AKT1, ALK, APC, ATM, BRAF, CDH1, CDKN2A, c-Kit, C-Met, CSF1R, CTNNB1, EGFR, ERBB2, ERBB4, FBXW7, FGFR1, FGFR2, FGFR3, FLT3, GNA11, GNAQ, GNAS, HNF1A, HRAS, IDH1, JAK2, JAK3, KDR, KRAS, MLH1, MPL, NOTCH1, NPM1, NRAS, PDGFRA, PIK3CA, PTEN, PTPN11, RB1, RET, SMAD4, SMARCB1, SMO, SRC, STK11, TP53, VHL |
| Mutated in cancers | ALK, BRAF, BRCA1, BRCA2, EGFR, ERRB2, GNA11, GNAQ, IDH1, IDH2, KIT, KRAS, MET, NRAS, PDGFRA, PIK3CA, PTEN, RET, SRC, TP53 |
| Mutated in cancers | AKT1, HRAS, GNAS, MEK1, MEK2, ERK1, ERK2, ERBB3, CDKN2A, PDGFRB, IFG1R, FGFR1, FGFR2, FGFR3, ERBB4, SMO, DDR2, GRB1, PTCH, SHH, PD1, UGT1A1, BIM, ESR1, MLL, AR, CDK4, SMAD4 |
| Mutated in cancers | ABL, APC, ATM, CDH1, CSFR1, CTNNB1, FBXW7, FLT3, HNF1A, JAK2, JAK3, KDR, MLH1, MPL, NOTCH1, NPM1, PTPN11, RB1, SMARCB1, STK11, VHL |
| Mutated in cancers | ABL1, AKT1, AKT2, AKT3, ALK, APC, AR, ARAF, ARFRP1, ARID1A, ARID2, ASXL1, ATM, ATR, ATRX, AURKA, AURKB, AXL, BAP1, BARD1, BCL2, BCL2L2, BCL6, BCOR, BCORL1, BLM, BRAF, BRCA1, BRCA2, BRIP1, BTK, CARD11, CBFB, CBL, CCND1, CCND2, CCND3, CCNE1, CD79A, CD79B, CDC73, CDH1, CDK12, CDK4, CDK6, CDK8, CDKN1B, CDKN2A, CDKN2B, CDKN2C, CEBPA, CHEK1, CHEK2, CIC, CREBBP, CRKL, CRLF2, CSF1R, CTCF, CTNNA1, CTNNB1, DAXX, DDR2, DNMT3A, DOT1L, EGFR, EMSY (C11orf30), EP300, EPHA3, EPHA5, EPHB1, ERBB2, ERBB3, ERBB4, ERG, ESR1, EZH2, FAM123B (WTX), FAM46C, FANCA, FANCC, FANCD2, FANCE, FANCF, FANCG, FANCL, FBXW7, FGF10, FGF14, FGF19, FGF23, FGF3, FGF4, FGF6, FGFR1, FGFR2, FGFR3, FGFR4, FLT1, FLT3, FLT4, FOXL2, GATA1, GATA2, GATA3, GID4 (C17orf39), GNA11, GNA13, GNAQ, GNAS, GPR124, GRIN2A, GSK3B, HGF, HRAS, IDH1, IDH2, IGF1R, IKBKE, IKZF1, IL7R, INHBA, IRF4, IRS2, JAK1, JAK2, JAK3, JUN, KAT6A (MYST3), KDM5A, KDM5C, KDM6A, KDR, KEAP1, KIT, KLHL6, KRAS, LRP1B, MAP2K1, MAP2K2, MAP2K4, MAP3K1, MCL1, MDM2, MDM4, MED12, MEF2B, MEN1, MET, MITF, MLH1, MLL, MLL2, MPL, MRE11A, MSH2, MSH6, MTOR, MUTYH, MYC, MYCL1, MYCN, MYD88, NF1, NF2, NFE2L2, NFKBIA, NKX2-1, NOTCH1, NOTCH2, NPM1, NRAS, NTRK1, NTRK2, NTRK3, NUP93, PAK3, PALB2, PAX5, PBRM1, PDGFRA, PDGFRB, PDK1, PIK3CA, PIK3CG, PIK3R1, PIK3R2, PPP2R1A, PRDM1, PRKAR1A, PRKDC, PTCH1, PTEN, PTPN11, |

TABLE 4-continued

Illustrative Biomarkers

| Illustrative Class | Biomarkers |
|---|---|
| | RAD50, RAD51, RAF1, RARA, RB1, RET, RICTOR, RNF43, RPTOR, RUNX1, SETD2, SF3B1, SMAD2, SMAD4, SMARCA4, SMARCB1, SMO, SOCS1, SOX10, SOX2, SPEN, SPOP, SRC, STAG2, STAT4, STK11, SUFU, TET2, TGFBR2, TNFAIP3, TNFRSF14, TOP1, TP53, TSC1, TSC2, TSHR, VHL, WISP3, WT1, XPO1, ZNF217, ZNF703 |
| Gene rearrangement in cancer | ALK, BCR, BCL2, BRAF, EGFR, ETV1, ETV4, ETV5, ETV6, EWSR1, MLL, MYC, NTRK1, PDGFRA, RAF1, RARA, RET, ROS1, TMPRSS2 |
| Cancer Related | ABL1, ACE2, ADA, ADH1C, ADH4, AGT, AKT1, AKT2, AKT3, ALK, APC, AR, ARAF, AREG, ARFRP1, ARID1A, ARID2, ASNS, ASXL1, ATM, ATR, ATRX, AURKA, AURKB, AXL, BAP1, BARD1, BCL2, BCL2L2, BCL6, BCOR, BCORL1, BCR, BIRC5 (survivin), BLM, BRAF, BRCA1, BRCA2, BRIP1, BTK, CA2, CARD11, CAV, CBFB, CBL, CCND1, CCND2, CCND3, CCNE1, CD33, CD52 (CDW52), CD79A, CD79B, CDC73, CDH1, CDK12, CDK2, CDK4, CDK6, CDK8, CDKN1B, CDKN2A, CDKN2B, CDKN2C, CEBPA, CES2, CHEK1, CHEK2, CIC, CREBBP, CRKL, CRLF2, CSF1R, CTCF, CTNNA1, CTNNB1, DAXX, DCK, DDR2, DHFR, DNMT1, DNMT3A, DNMT3B, DOT1L, EGFR, EMSY (C11orf30), EP300, EPHA2, EPHA3, EPHA5, EPHB1, ERBB2, ERBB3, ERBB4, ERBR2 (typo?), ERCC3, EREG, ERG, ESR1, ETV1, ETV4, ETV5, ETV6, EWSR1, EZH2, FAM123B (WTX), FAM46C, FANCA, FANCC, FANCD2, FANCE, FANCF, FANCG, FANCL, FBXW7, FGF10, FGF14, FGF19, FGF23, FGF3, FGF4, FGF6, FGFR1, FGFR2, FGFR3, FGFR4, FLT1, FLT3, FLT4, FOLR1, FOLR2, FOXL2, FSHB, FSHPRH1, FSHR, GART, GATA1, GATA2, GATA3, GID4 (C17orf39), GNA11, GNA13, GNAQ, GNAS, GNRH1, GNRHR1, GPR124, GRIN2A, GSK3B, GSTP1, HDAC1, HGF, HIG1, HNF1A, HRAS, HSPCA (HSP90), IDH1, IDH2, IGF1R, IKBKE, IKZF1, IL13RA1, IL2, IL2RA (CD25), IL7R, INHBA, IRF4, IRS2, JAK1, JAK2, JAK3, JUN, KAT6A (MYST3), KDM5A, KDM5C, KDM6A, KDR (VEGFR2), KEAP1, KIT, KLHL6, KRAS, LCK, LRP1B, LTB, LTBR, MAP2K1, MAP2K2, MAP2K4, MAP3K1, MAPK, MCL1, MDM2, MDM4, MED12, MEF2B, MEN1, MET, MGMT, MITF, MLH1, MLL, MLL2, MPL, MRE11A, MS4A1 (CD20), MSH2, MSH6, MTAP, MTOR, MUTYH, MYC, MYCL1, MYCN, MYD88, NF1, NF2, NFE2L2, NFKB1, NFKB2, NFKBIA, NGF, NKX2-1, NOTCH1, NOTCH2, NPM1, NRAS, NTRK1, NTRK2, NTRK3, NUP93, ODC1, OGFR, PAK3, PALB2, PAX5, PBRM1, PDGFC, PDGFRA, PDGFRB, PDK1, PGP, PGR (PR), PIK3CA, PIK3CG, PIK3R1, PIK3R2, POLA, PPARG, PPARGC1, PPP2R1A, PRDM1, PRKAR1A, PRKDC, PTCH1, PTEN, PTPN11, RAD50, RAD51, RAF1, RARA, RB1, RET, RICTOR, RNF43, ROS1, RPTOR, RRM1, RRM2, RRM2B, RUNX1, RXR, RXRB, RXRG, SETD2, SF3B1, SMAD2, SMAD4, SMARCA4, SMARCB1, SMO, SOCS1, SOX10, SOX2, SPARC, SPEN, SPOP, SRC, SST, SSTR1, SSTR2, SSTR3, SSTR4, SSTR5, STAG2, STAT4, STK11, SUFU, TET2, TGFBR2, TK1, TLE3, TMPRSS2, TNF, TNFAIP3, TNFRSF14, TOP1, TOP2, TOP2A, TOP2B, TP53, TS, TSC1, TSC2, TSHR, TUBB3, TXN, TYMP, VDR, VEGF (VEGFA), VEGFC, VHL, WISP3, WT1, XDH, XPO1, YES1, ZAP70, ZNF217, ZNF703 |
| Cancer Related | 5T4, ABI1, ABL1, ABL2, ACKR3, ACSL3, ACSL6, ACVR1B, ACVR2A, AFF1, AFF3, AFF4, AKAP9, AKT1, AKT2, AKT3, ALDH2, ALK, AMER1, ANG1/ANGPT1/TM7SF2, ANG2/ANGPT2/VPS51, APC, AR, ARAF, ARFRP1, ARHGAP26, ARHGEF12, ARID1A, ARID1B, ARID2, ARNT, ASPSCR1, ASXL1, ATF1, ATIC, ATM, ATP1A1, ATP2B3, ATR, ATRX, AURKA, AURKB, AXIN1, AXL, BAP1, BARD1, BBC3, BCL10, BCL11A, BCL11B, BCL2, BCL2L1, BCL2L11, BCL2L2, BCL3, BCL6, BCL7A, BCL9, BCOR, BCORL1, BCR, BIRC3, BLM, BMPR1A, BRAF, BRCA1, BRCA2, BRD3, BRD4, BRIP1, BTG1, BTK, BUB1B, c-KIT, C11orf30, c15orf21, C15orf65, C2orf44, CA6, CACNA1D, CALR, CAMTA1, CANT1, CARD11, CARS, CASC5, CASP8, CBFA2T3, CBFB, CBL, CBLB, CBLC, CCDC6, CCNB1IP1, CCND1, CCND2, CCND3, CCNE1, CD110, CD123, CD137, CD19, CD20, CD274, CD27L, CD38, CD4, CD74, CD79A, CD79B, CDC73, CDH1, CDH11, CDK12, CDK4, CDK6, CDK7, CDK8, CDK9, CDKN1A, CDKN1B, CDKN2A, CDKN2B, CDKN2C, CDX2, CEBPA, CHCHD7, CHD2, CHD4, CHEK1, CHEK2, CHIC2, Chk1, CHN1, CIC, CIITA, CLP1, CLTC, CLTCL1, CNBP, CNOT3, CNTRL, COL1A1, COPB1, CoREST, COX6C, CRAF, CREB1, CREB3L1, CREB3L2, CREBBP, CRKL, CRLF2, CRTC1, CRTC3, CSF1R, CSF3R, CTCF, CTLA4, CTNNA1, CTNNB1, CUL3, CXCR4, CYLD, CYP17A1, CYP2D6, DAXX, DDB2, DDIT3, DDR1, DDR2, DDX10, DDX5, DDX6, DEK, DICER1, DLL-4, DNAPK, DNM2, DNMT3A, DOT1L, EBF1, ECT2L, EGFR, EIF4A2, ELF4, ELK4, ELL, ELN, EML4, EP300, EPHA3, EPHA5, EPHA7, EPHA8, EPHB1, EPHB2, EPS15, ERBB2, ERBB3, ERBB4, ERCC1, ERCC2, ERCC3, ERCC4, ERCC5, ERG, ERRFI1, ESR1, ETBR, ETV1, ETV4, ETV5, ETV6, EWSR1, EXT1, EXT2, EZH2, EZR, FAK, FAM46C, FANCA, FANCC, FANCD2, FANCE, FANCF, FANCG, FANCL, FAS, FAT1, FBXO11, FBXW7, FCRL4, FEV, FGF10, FGF14, FGF19, FGF2, FGF23, FGF3, FGF4, FGF6, FGFR1, FGFR1OP, FGFR2, FGFR3, FGFR4, FH, FHIT, FIP1L1, FKBP12, FLCN, FLI1, FLT1, FLT3, FLT4, FNBP1, FOXA1, FOXL2, FOXO1, FOXO3, FOXO4, FOXP1, FRS2, FSTL3, FUBP1, FUS, GABRA6, GAS7, GATA1, GATA2, GATA3, GATA4, GATA6, GID4, GITR, GUI1, GMPS, GNA11, GNA13, GNAQ, GNAS, GNRH1, GOLGA5, GOPC, GPC3, GPHN, GPR124, GRIN2A, GRM3, GSK3B, GUCY2C, H3F3A, H3F3B, HCK, HERPUD1, HEY1, HGF, HIP1, HIST1H3B, HIST1H4I, HLF, HMGA1, HMGA2, HMT, HNF1A, HNRNPA2B1, HOOK3, HOXA11, HOXA13, HOXA9, HOXC11, HOXC13, HOXD11, HOXD13, HRAS, HSD3B1, HSP90AA1, HSP90AB1, IAP, IDH1, IDH2, IGF1R, IGF2, IKBKE, IKZF1, IL2, IL21R, IL6, IL6ST, IL7R, INHBA, INPP4B, IRF2, IRF4, IRS2, ITGAV, ITGB1, ITK, JAK1, JAK2, JAK3, JAZF1, JUN, KAT6A, KAT6B, KCNJ5, KDM5A, KDM5C, KDM6A, KDR, KDSR, KEAP1, KEL, KIAA1549, KIF5B, KIR3DL1, KLF4, KLHL6, KLK2, KMT2A, KMT2C, KMT2D, KRAS, KTN1, LASP1, LCK, LCP1, LGALS3, LGR5, LHFP, LIFR, LMO1, LMO2, LOXL2, LPP, LRIG3, LRP1B, LSD1, LYL1, LYN, LZTR1, MAF, MAFB, |

TABLE 4-continued

Illustrative Biomarkers

| Illustrative Class | Biomarkers |
|---|---|
| | MAGI2, MALT1, MAML2, MAP2K1, MAP2K2, MAP2K4, MAP3K1, MAPK1, MAPK11, MAX, MCL1, MDM2, MDM4, MDS2, MECOM, MED12, MEF2B, MEK1, MEK2, MEN1, MET, MITF, MKL1, MLF1, MLH1, MLLT1, MLLT10, MLLT11, MLLT3, MLLT4, MLLT6, MMP9, MN1, MNX1, MPL, MPS1, MRE11A, MS4A1, MSH2, MSH6, MSI2, MSN, MST1R, MTCP1, MTOR, MUC1, MUC16, MUTYH, MYB, MYC, MYCL, MYCN, MYD88, MYH11, MYH9, NACA, NAE1, NBN, NCKIPSD, NCOA1, NCOA2, NCOA4, NDRG1, NF1, NF2, NFE2L2, NFIB, NFKB2, NFKBIA, NIN, NKX2-1, NONO, NOTCH1, NOTCH2, NOTCH3, NPM1, NR4A3, NRAS, NSD1, NT5C2, NTRK1, NTRK2, NTRK3, NUMA1, NUP214, NUP93, NUP98, NUTM1, NUTM2B, OLIG2, OMD, P2RY8, PAFAH1B2, PAK3, PALB2, PARK2, PARP1, PATZ1, PAX3, PAX5, PAX7, PAX8, PBRM1, PBX1, PCM1, PCSK7, PDCD1, PDCD1LG2, PDE4DIP, PDGFB, PDGFRA, PDGFRB, PDK1, PER1, PHF6, PHOX2B, PICALM, PIK3C2B, PIK3CA, PIK3CB, PIK3CD, PIK3CG, PIK3R1, PIK3R2, PIM1, PKC, PLAG1, PLCG2, PML, PMS1, PMS2, POLD1, POLE, POT1, POU2AF1, POU5F1, PPARG, PPP2R1A, PRCC, PRDM1, PRDM16, PREX2, PRF1, PRKAR1A, PRKCI, PRKDC, PRLR, PRRX1, PRSS8, PSIP1, PTCH1, PTEN, PTK2, PTPN11, PTPRC, PTPRD, QKI, RABEP1, RAC1, RAD21, RAD50, RAD51, RAD51B, RAF1, RALGDS, RANBP17, RANBP2, RANKL, RAP1GDS1, RARA, RB1, RBM10, RBM15, RECQL4, REL, RET, RHOH, RICTOR, RMI2, RNF213, RNF43, ROS1, RPL10, RPL20, RPL5, RPN1, RPS6KB1, RPTOR, RUNX1, RUNx1T1, SBDS, SDC4, SDHA, SDHAF2, SDHB, SDHC, SDHD, SEPT5, SEPT6, SEPT9, SET, SETBP1, SETD2, SF3B1, SFPQ, SH2B3, SH3GL1, SLAMF7, SLC34A2, SLC45A3, SLIT2, SMAD2, SMAD3, SMAD4, SMARCA4, SMARCB1, SMARCE1, SMO, SNCAIP, SNX29, SOCS1, SOX10, SOX2, SOX9, SPECC1, SPEN, SPOP, SPTA1, SRC, SRGAP3, SRSF2, SRSF3, SS18, SS18L1, SSX1, SSX2, SSX4, STAG2, STAT3, STAT4, STAT5B, STEAP1, STIL, STK11, SUFU, SUZ12, SYK, TAF1, TAF15, TAL1, TAL2, TBL1XR1, TBX3, TCEA1, TCF12, TCF3, TCF7L2, TCL1A, TERC, TERT, TET1, TET2, TFE3, TFEB, TFG, TFPT, TFRC, TGFB1, TGFBR2, THRAP3, TIE2, TLX1, TLX3, TMPRSS2, TNFAIP3, TNFRSF14, TNFRSF17, TOP1, TOP2A, TP53, TPM3, TPM4, TPR, TRAF7, TRIM26, TRIM27, TRIM33, TRIP11, TRRAP, TSC1, TSC2, TSHR, TTL, U2AF1, UBA1, UBR5, USP6, VEGFA, VEGFB, VEGFR, VHL, VTI1A, WAS, WEE1, WHSC1, WHSC1L1, WIF1, WISP3, WNT11, WNT2B, WNT3, WNT3A, WNT4, WNT5A, WNT6, WNT7B, WRN, WT1, WWTR1, XPA, XPC, XPO1, YWHAE, ZAK, ZBTB16, ZBTB2, ZMYM2, ZNF217, ZNF331, ZNF384, ZNF521, ZNF703, ZRSR2 |
| Cancer Related | ABL2, ACSL3, ACSL6, AFF1, AFF3, AFF4, AKAP9, AKT3, ALDH2, APC, ARFRP1, ARHGAP26, ARHGEF12, ARID2, ARNT, ASPSCR1, ASXL1, ATF1, ATIC, ATM, ATP1A1, ATR, AURKA, AXIN1, AXL, BAP1, BARD1, BCL10, BCL11A, BCL2L11, BCL3, BCL6, BCL7A, BCL9, BCR, BIRC3, BLM, BMPR1A, BRAF, BRCA1, BRCA2, BRIP1, BUB1B, C11orf30, C2orf44, CACNA1D, CALR, CAMTA1, CANT1, CARD11, CARS, CASC5, CASP8, CBFA2T3, CBFB, CBL, CBLB, CCDC6, CCNB1IP1, CCND2, CD274, CD74, CD79A, CDC73, CDH11, CDKN1B, CDX2, CHEK1, CHEK2, CHIC2, CHN1, CIC, CIITA, CLP1, CLTC, CLTCL1, CNBP, CNTRL, COPB1, CREB1, CREB3L1, CREB3L2, CRTC1, CRTC3, CSF1R, CSF3R, CTCF, CTLA4, CTNNA1, CTNNB1, CYLD, CYP2D6, DAXX, DDR2, DDX10, DDX5, DDX6, DEK, DICER1, DOT1L, EBF1, ECT2L, ELK4, ELL, EML4, EPHA3, EPHA5, EPHB1, EPS15, ERBB3, ERBB4, ERC1, ERCC2, ERCC3, ERCC4, ERCC5, ERG, ESR1, ETV1, ETV5, ETV6, EWSR1, EXT1, EXT2, EZR, FANCA, FANCC, FANCD2, FANCE, FANCG, FANCL, FAS, FBXO11, FBXW7, FCRL4, FGF14, FGF19, FGF23, FGF6, FGFR1OP, FGFR4, FH, FHIT, FIP1L1, FLCN, FLI1, FLT1, FLT3, FLT4, FNBP1, FOXA1, FOXO1, FOXP1, FUBP1, FUS, GAS7, GID4, GMPS, GNA13, GNAQ, GNAS, GOLGA5, GOPC, GPHN, GPR124, GRIN2A, GSK3B, H3F3A, H3F3B, HERPUD1, HGF, HIP1, HMGA1, HMGA2, HNRNPA2B1, HOOK3, HSP90AA1, HSP90AB1, IDH1, IDH2, IGF1R, IKZF1, IL2, IL21R, IL6ST, IL7R, IRF4, ITK, JAK1, JAK2, JAK3, JAZF1, KDM5A, KEAP1, KIAA1549, KIF5B, KIT, KLHL6, KMT2A, KMT2C, KMT2D, KRAS, KTN1, LCK, LCP1, LGR5, LHFP, LIFR, LPP, LRIG3, LRP1B, LYL1, MAF, MALT1, MAML2, MAP2K2, MAP2K4, MAP3K1, MDM4, MDS2, MEF2B, MEN1, MITF, MLF1, MLH1, MLLT1, MLLT10, MLLT3, MLLT4, MLLT6, MNX1, MRE11A, MSH2, MSH6, MSI2, MTOR, MYB, MYCN, MYD88, MYH11, MYH9, NACA, NCKIPSD, NCOA1, NCOA2, NCOA4, NF1, NFE2L2, NFIB, NFKB2, NIN, NOTCH2, NPM1, NR4A3, NSD1, NT5C2, NTRK2, NTRK3, NUP214, NUP93, NUP98, NUTM1, PALB2, PAX3, PAX5, PAX7, PBRM1, PBX1, PCM1, PCSK7, PDCD1, PDCD1LG2, PDGFB, PDGFRA, PDGFRB, PDK1, PER1, PICALM, PIK3CA, PIK3R1, PIK3R2, PIM1, PML, PMS2, POLE, POT1, POU2AF1, PPARG, PRCC, PRDM1, PRDM16, PRKAR1A, PRRX1, PSIP1, PTCH1, PTEN, PTPN11, PTPRC, RABEP1, RAC1, RAD50, RAD51, RAD51B, RAF1, RALGDS, RANBP17, RAP1GDS1, RARA, RBM15, REL, RET, RMI2, RNF43, RPL22, RPL5, RPN1, RPTOR, RUNX1, RUNX1T1, SBDS, SDC4, SDHAF2, SDHB, SDHC, SDHD, 8-Sep, SET, SETBP1, SETD2, SF3B1, SH2B3, SH3GL1, SLC34A2, SMAD2, SMAD4, SMARCB1, SMARCE1, SMO, SNX29, SOX10, SPECC1, SPEN, SRGAP3, SRSF2, SRSF3, SS18, SS18L1, STAT3, STAT4, STAT5B, STIL, STK11, SUFU, SUZ12, SYK, TAF15, TCF12, TCF3, TCF7L2, TET1, TET2, TFEB, TFG, TFRC, TGFBR2, TLX1, TNFAIP3, TNFRSF14, TNFRSF17, TP53, TPM3, TPM4, TPR, TRAF7, TRIM26, TRIM27, TRIM33, TRIP11, TRRAP, TSC1, TSC2, TSHR, TTL, U2AF1, USP6, VEGFA, VEGFB, VTI1A, WHSC1, WHSC1L1, WIF1, WISP3, WRN, WWTR1, XPA, XPC, XPO1, YWHAE, ZMYM2, ZNF217, ZNF331, ZNF384, ZNF521, ZNF703 |
| Gene fusions and mutations in cancer | AKT3, ALK, ARHGAP26, AXL, BRAF, BRD3/4, EGFR, ERG, ESR1, ETV1/4/5/6, EWSR1, FGFR1, FGFR2, FGFR3, FGR, INSR, MAML2, MAST1/2, MET, MSMB, MUSK, MYB, NOTCH1/2, NRG1, NTRK1/2/3, NUMBL, NUTM1, PDGFRA/B, PIK3CA, PKN1, |

TABLE 4-continued

Illustrative Biomarkers

| Illustrative Class | Biomarkers |
|---|---|
| | PPARG, PRKCA/B, RAF1, RELA, RET, ROS1, RSPO2/3, TERT, TFE3, TFEB, THADA, TMPRSS2 |
| Gene fusions and mutations in cancer | ABL1 fusion to (ETV6, NUP214, RCSD1, RANBP2, SNX2, or ZMIZ1); ABL2 fusion to (PAG1 or RCSD1); CSF1R fusion to (SSBP2); PDGFRB fusion to (EBF1, SSBP2, TNIP1 or ZEB2); CRLF2 fusion to (P2RY8); JAK2 fusion to (ATF7IP, BCR, ETV6, PAX5, PPFIBP1, SSBP2, STRN3, TERP2, or TPR); EPOR fusion to (IGH or IGK); IL2RB fusion to (MYH9); NTRK3 fusion to (ETV6); PTK2B fusion to (KDM6A or STAG2); TSLP fusion to (IQGAP2); TYK2 fusion to (MYB) |
| Cytohesions | cytohesin-1 (CYTH1), cytohesin-2 (CYTH2; ARNO), cytohesin-3 (CYTH3; Grp1; ARNO3), cytohesin-4 (CYTH4) |
| Cancer/Angio | Erb 2, Erb 3, Erb 4, UNC93a, B7H3, MUC1, MUC2, MUC16, MUC17, 5T4, RAGE, VEGF A, VEGFR2, FLT1, DLL4, Epcam |
| Tissue (Breast) | BIG H3, GCDFP-15, PR(B), GPR 30, CYFRA 21, BRCA 1, BRCA 2, ESR 1, ESR2 |
| Tissue (Prostate) | PSMA, PCSA, PSCA, PSA, TMPRSS2 |
| Inflammation/Immune | MFG-E8, IFNAR, CD40, CD80, MICB, HLA-DRb, IL-17-Ra |
| Common vesicle markers | HSPA8, CD63, Actb, GAPDH, CD9, CD81, ANXA2, HSP90AA1, ENO1, YWHAZ, PDCD6IP, CFL1, SDCBP, PKN2, MSN, MFGE8, EZR, YWHAG, PGK1, EEF1A1, PPIA, GLC1F, GK, ANXA6, ANXA1, ALDOA, ACTG1, TPI1, LAMP2, HSP90AB1, DPP4, YWHAB, TSG101, PFN1, LDHB, HSPA1B, HSPA1A, GSTP1, GNAI2, GDI2, CLTC, ANXA5, YWHAQ, TUBA1A, THBS1, PRDX1, LDHA, LAMP1, CLU, CD86 |
| Common vesicle membrane markers | CD63, GAPDH, CD9, CD81, ANXA2, ENO1, SDCBP, MSN, MFGE8, EZR, GK, ANXA1, LAMP2, DPP4, TSG101, HSPA1A, GDI2, CLTC, LAMP1, CD86, ANPEP, TFRC, SLC3A2, RDX, RAP1B, RAB5C, RAB5B, MYH9, ICAM1, FN1, RAB11B, PIGR, LGALS3, ITGB1, EHD1, CLIC1, ATP1A1, ARF1, RAP1A, P4HB, MUC1, KRT10, HLA-A, FLOT1, CD59, C1orf58, BASP1, TACSTD1, STOM |
| Common vesicle markers | MHC class I, MHC class II, Integrins, Alpha 4 beta 1, Alpha M beta 2, Beta 2, ICAM1/CD54, P-selection, Dipeptidylpeptidase IV/CD26, Aminopeptidase n/CD13, CD151, CD53, CD37, CD82, CD81, CD9, CD63, Hsp70, Hsp84/90<br>Actin, Actin-binding proteins, Tubulin, Annexin I, Annexin II, Annexin IV, Annexin V, Annexin VI, RAB7/RAP1B/RADGDI, Gi2alpha/14-3-3, CBL/LCK, CD63, GAPDH, CD9, CD81, ANXA2, ENO1, SDCBP, MSN, MFGE8, EZR, GK, ANXA1, LAMP2, DPP4, TSG101, HSPA1A, GDI2, CLTC, LAMP1, Cd86, ANPEP, TFRC, SLC3A2, RDX, RAP1B, RAB5C, RAB5B, MYH9, ICAM1, FN1, RAB11B, PIGR, LGALS3, ITGB1, EHD1, CLIC1, ATP1A1, ARF1, RAP1A, P4HB, MUC1, KRT10, HLA-A, FLOT1, CD59, C1orf58, BASP1, TACSTD1, STOM |
| Vesicle markers | A33, a33 n15, AFP, ALA, ALIX, ALP, AnnexinV, APC, ASCA, ASPH (246-260), ASPH (666-680), ASPH (A-10), ASPH (D01P), ASPH (D03), ASPH (G-20), ASPH (H-300), AURKA, AURKB, B7H3, B7H4, BCA-225, BCNP, BDNF, BRCA, CA125 (MUC16), CA-19-9, C-Bir, CD1.1, CD10, CD174 (Lewis y), CD24, CD44, CD46, CD59 (MEM-43), CD63, CD66e CEA, CD73, CD81, CD9, CDA, CDAC1 1a2, CEA, C-Erb2, C-erbB2, CRMP-2, CRP, CXCL12, CYFRA21-1, DLL4, DR3, EGFR, Epcam, EphA2, EphA2 (H-77), ER, ErbB4, EZH2, FASL, FRT, FRT c.f23, GDF15, GPCR, GPR30, Gro-alpha, HAP, HBD 1, HBD2, HER 3 (ErbB3), HSP, HSP70, hVEGFR2, iC3b, IL 6 Unc, IL-1B, IL6 Unc, IL6R, IL8, IL-8, INSIG-2, KLK2, L1CAM, LAMN, LDH, MACC-1, MAPK4, MART-1, MCP-1, M-CSF, MFG-E8, MIC1, MIF, MIS RII, MMG, MMP26, MMP7, MMP9, MS4A1, MUC1, MUC1 seq1, MUC1 seq11A, MUC17, MUC2, Ncam, NGAL, NGP/NPFF2, OPG, OPN, p53, p53, PA2G4, PBP, PCSA, PDGFRB, PGP9.5, PIM1, PR (B), PRL, PSA, PSMA, PSME3, PTEN, R5-CD9 Tube 1, Reg IV, RUNX2, SCRN1, seprase, SERPINB3, SPARC, SPB, SPDEF, SRVN, STAT 3, STEAP1, TF (FL-295), TFF3, TGM2, TIMP-1, TIMP1, TIMP2, TMEM211, TMPRSS2, TNF-alpha, Trail-R2, Trail-R4, TrKB, TROP2, Tsg 101, TWEAK, UNC93A, VEGF A, YPSMA-1 |
| Vesicle markers | NSE, TRIM29, CD63, CD151, ASPH, LAMP2, TSPAN1, SNAIL, CD45, CKS1, NSE, FSHR, OPN, FTH1, PGP9, ANNEXIN 1, SPD, CD81, EPCAM, PTH1R, CEA, CYTO 7, CCL2, SPA, KRAS, TWIST1, AURKB, MMP9, P27, MMP1, HLA, HIF, CEACAM, CENPH, BTUB, INTG b4, EGFR, NACC1, CYTO 18, NAP2, CYTO 19, ANNEXIN V, TGM2, ERB2, BRCA1, B7H3, SFTPC, PNT, NCAM, MS4A1, P53, INGA3, MUC2, SPA, OPN, CD63, CD9, MUC1, UNCR3, PAN ADH, HCG, TIMP, PSMA, GPCR, RACK1, PSCA, VEGF, BMP2, CD81, CRP, PRO GRP, B7H3, MUC1, M2PK, CD9, PCSA, PSMA |
| Vesicle markers | TFF3, MS4A1, EphA2, GAL3, EGFR, N-gal, PCSA, CD63, MUC1, TGM2, CD81, DR3, MACC-1, TrKB, CD24, TIMP-1, A33, CD66 CEA, PRL, MMP9, MMP7, TMEM211, SCRN1, TROP2, TWEAK, CDACC1, UNC93A, APC, C-Erb, CD10, BDNF, FRT, GPR30, P53, SPR, OPN, MUC2, GRO-1, tsg 101, GDF15 |
| Vesicle markers | CD9, Erb2, Erb4, CD81, Erb3, MUC16, CD63, DLL4, HLA-Drpe, B7H3, IFNAR, 5T4, PCSA, MICE, PSMA, MFG-E8, Muc1, PSA, Muc2, Unc93a, VEGFR2, EpCAM, VEGF A, TMPRSS2, RAGE, PSCA, CD40, Muc17, IL-17-RA, CD80 |
| Benign Prostate Hyperplasia (BPH) | BCMA, CEACAM-1, HVEM, IL-1 R4, IL-10 Rb, Trappin-2, p53, hsa-miR-329, hsa-miR-30a, hsa-miR-335, hsa-miR-152, hsa-miR-151-5p, hsa-miR-200a, hsa-miR-145, hsa-miR-29a, hsa-miR-106b, hsa-miR-595, hsa-miR-142-5p, hsa-miR-99a, hsa-miR-20b, hsa-miR-373, hsa-miR-502-5p, hsa-miR-29b, hsa-miR-142-3p, hsa-miR-663, hsa-miR-423-5p, hsa-miR-15a, hsa-miR-888, hsa-miR-361-3p, hsa-miR-365, hsa-miR-10b, hsa-miR-199a-3p, hsa-miR-181a, hsa-miR-19a, hsa-miR-125b, hsa-miR-760, hsa-miR-7a, hsa-miR-671-5p, hsa-miR-7c, hsa-miR-1979, hsa-miR-103 |
| Metastatic Prostate Cancer | hsa-miR-100, hsa-miR-1236, hsa-miR-1296, hsa-miR-141, hsa-miR-146b-5p, hsa-miR-17*, hsa-miR-181a, hsa-miR-200b, hsa-miR-20a*, hsa-miR-23a*, hsa-miR-331-3p, hsa-miR-375, hsa-miR-452, hsa-miR-572, hsa-miR-574-3p, hsa-miR-577, hsa-miR-582-3p, hsa-miR-937, |

TABLE 4-continued

Illustrative Biomarkers

| Illustrative Class | Biomarkers |
|---|---|
| | miR-10a, miR-134, miR-141, miR-200b, miR-30a, miR-32, miR-375, miR-495, miR-564, miR-570, miR-574-3p, miR-885-3p |
| Metastatic Prostate Cancer | hsa-miR-200b, hsa-miR-375, hsa-miR-141, hsa-miR-331-3p, hsa-miR-181a, hsa-miR-574-3p |
| Prostate Cancer | hsa-miR-574-3p, hsa-miR-141, hsa-miR-432, hsa-miR-326, hsa-miR-2110, hsa-miR-181a-2*, hsa-miR-107, hsa-miR-301a, hsa-miR-484, hsa-miR-625* |
| Metastatic Prostate Cancer | hsa-miR-582-3p, hsa-miR-20a*, hsa-miR-375, hsa-miR-200b, hsa-miR-379, hsa-miR-572, hsa-miR-513a-5p, hsa-miR-577, hsa-miR-23a*, hsa-miR-1236, hsa-miR-609, hsa-miR-17*, hsa-miR-130b, hsa-miR-619, hsa-miR-624*, hsa-miR-198 |
| Metastatic Prostate Cancer | FOX01A, SOX9, CLNS1A, PTGDS, XPO1, LETMD1, RAD23B, ABCC3, APC, CHES1, EDNRA, FRZB, HSPG2, TMPRSS2_ETV1 fusion |
| Prostate Cancer | hsa-let-7b, hsa-miR-107, hsa-miR-1205, hsa-miR-1270, hsa-miR-130b, hsa-miR-141, hsa-miR-143, hsa-miR-148b*, hsa-miR-150, hsa-miR-154*, hsa-miR-181a*, hsa-miR-181a-2*, hsa-miR-18a*, hsa-miR-19b-1*, hsa-miR-204, hsa-miR-2110, hsa-miR-215, hsa-miR-217, hsa-miR-219-2-3p, hsa-miR-23b*, hsa-miR-299-5p, hsa-miR-301a, hsa-miR-301a, hsa-miR-326, hsa-miR-331-3p, hsa-miR-365*, hsa-miR-373*, hsa-miR-424, hsa-miR-424*, hsa-miR-432, hsa-miR-450a, hsa-miR-451, hsa-miR-484, hsa-miR-497, hsa-miR-517*, hsa-miR-517a, hsa-miR-518f, hsa-miR-574-3p, hsa-miR-595, hsa-miR-617, hsa-miR-625*, hsa-miR-628-5p, hsa-miR-629, hsa-miR-634, hsa-miR-769-5p, hsa-miR-93, hsa-miR-96 |
| Prostate Cancer | CD9, PSMA, PCSA, CD63, CD81, B7H3, IL 6, OPG-13, IL6R, PA2G4, EZH2, RUNX2, SERPINB3, EpCam |
| Prostate Cancer | A33, a33 n15, AFP, ALA, ALIX, ALP, AnnexinV, APC, ASCA, ASPH (246-260), ASPH (666-680), ASPH (A-10), ASPH (D01P), ASPH (D03), ASPH (G-20), ASPH (H-300), AURKA, AURKB, B7H3, B7H4, BCA-225, BCNP, BDNF, BRCA, CA125 (MUC16), CA-19-9, C-Bir, CD1.1, CD10, CD174 (Lewis y), CD24, CD44, CD46, CD59 (MEM-43), CD63, CD66e CEA, CD73, CD81, CD9, CDA, CDAC1 1a2, CEA, C-Erb2, C-erbB2, CRMP-2, CRP, CXCL12, CYFRA21-1, DLL4, DR3, EGFR, Epcam, EphA2, EphA2 (H-77), ER, ErbB4, EZH2, FASL, FRT, FRT c.f23, GDF15, GPCR, GPR30, Gro-alpha, HAP, HBD 1, HBD2, HER 3 (ErbB3), HSP, HSP70, hVEGFR2, iC3b, IL 6 Unc, IL-1B, IL6 Unc, IL6R, IL8, IL-8, INSIG-2, KLK2, L1CAM, LAMN, LDH, MACC-1, MAPK4, MART-1, MCP-1, M-CSF, MFG-E8, MIC1, MIF, MIS RII, MMG, MMP26, MMP7, MMP9, MS4A1, MUC1, MUC1 seq1, MUC1 seq11A, MUC17, MUC2, Ncam, NGAL, NPGP/NPFF2, OPG, OPN, p53, p53, PA2G4, PBP, PCSA, PDGFRB, PGP9.5, PIM1, PR (B), PRL, PSA, PSMA, PSME3, PTEN, R5-CD9 Tube 1, Reg IV, RUNX2, SCRN1, seprase, SERPINB3, SPARC, SPB, SPDEF, SRVN, STAT 3, STEAP1, TF (FL-295), TFF3, TGM2, TIMP-1, TIMP1, TIMP2, TMEM211, TMPRSS2, TNF-alpha, Trail-R2, Trail-R4, TrKB, TROP2, Tsg 101, TWEAK, UNC93A, VEGF A, YPSMA-1 |
| Prostate Cancer Vesicle Markers | 5T4, ACTG1, ADAM10, ADAM15, ALDOA, ANXA2, ANXA6, APOA1, ATP1A1, BASP1, C1orf58, C20orf114, C8B, CAPZA1, CAV1, CD151, CD2AP, CD59, CD9, CD9, CFL1, CFP, CHMP4B, CLTC, COTL1, CTNND1, CTSB, CTSZ, CYCS, DPP4, EEF1A1, EHD1, ENO1, F11R, F2, F5, FAM125A, FNBP1L, FOLH1, GAPDH, GLB1, GPX3, HIST1H1C, HIST1H2AB, HSP90AB1, HSPA1B, HSPA8, IGSF8, ITGB1, ITIH3, JUP, LDHA, LDHB, LUM, LYZ, MFGE8, MGAM, MMP9, MYH2, MYL6B, NME1, NME2, PABPC1, PABPC4, PACSIN2, PCBP2, PDCD6IP, PRDX2, PSA, PSMA, PSMA1, PSMA2, PSMA4, PSMA6, PSMA7, PSMB1, PSMB2, PSMB3, PSMB4, PSMB5, PSMB6, PSMB8, PTGFRN, RPS27A, SDCBP, SERINC5, SH3GL1, SLC3A2, SMPDL3B, SNX9, TACSTD1, TCN2, THBS1, TPI1, TSG101, TUBB, VDAC2, VPS37B, YWHAG, YWHAQ, YWHAZ |
| Prostate Cancer Vesicle Markers | FLNA, DCRN, HER 3 (ErbB3), VCAN, CD9, GAL3, CDADC1, GM-CSF, EGFR, RANK, CSA, PSMA, ChickenIgY, B7H3, PCSA, CD63, CD3, MUC1, TGM2, CD81, S100-A4, MFG-E8, Integrin, NK-2R(C-21), PSA, CD24, TIMP-1, IL6 Unc, PBP, PIM1, CA-19-9, Trail-R4, MMP9, PRL, EphA2, TWEAK, NY-ESO-1, Mammaglobin, UNC93A, A33, AURKB, CD41, XAGE-1, SPDEF, AMACR, seprase/FAP, NGAL, CXCL12, FRT, CD66e CEA, SIM2 (C-15), C-Bir, STEAP, PSIP1/LEDGF, MUC17, hVEGFR2, ERG, MUC2, ADAM10, ASPH (A-10), CA125, Gro-alpha, Tsg 101, SSX2, Trail-R4 |
| Prostate Cancer Vesicle Markers | NT5E (CD73), A33, ABL2, ADAM10, AFP, ALA, ALIX, ALPL, AMACR, Apo J/CLU, ASCA, ASPH (A-10), ASPH (D01P), AURKB, B7H3, B7H4, BCNP, BDNF, CA125 (MUC16), CA-19-9, C-Bir (Flagellin), CD10, CD151, CD24, CD3, CD41, CD44, CD46, CD59(MEM-43), CD63, CD66e CEA, CD81, CD9, CDA, CDADC1, C-erbB2, CRMP-2, CRP, CSA, CXCL12, CXCR3, CYFRA21-1, DCRN, DDX-1, DLL4, EGFR, EpCAM, EphA2, ERG, EZH2, FASL, FLNA, FRT, GAL3, GATA2, GM-CSF, Gro-alpha, HAP, HER3 (ErbB3), HSP70, HSPB1, hVEGFR2, iC3b, IL-1B, IL6 R, IL6 Unc, IL7 R alpha/CD127, IL8, INSIG-2, Integrin, KLK2, Label, LAMN, Mammaglobin, M-CSF, MFG-E8, MIF, MIS RII, MMP7, MMP9, MS4A1, MUC1, MUC17, MUC2, Ncam, NDUFB7, NGAL, NK-2R(C-21), NY-ESO-1, p53, PBP, PCSA, PDGFRB, PIM1, PRL, PSA, PSIP1/LEDGF, PSMA, RAGE, RANK, Reg IV, RUNX2, S100-A4, seprase/FAP, SERPINB3, SIM2 (C-15), SPARC, SPC, SPDEF, SPP1, SSX2, SSX4, STEAP, STEAP4, TFF3, TGM2, TIMP-1, TMEM211, Trail-R2, Trail-R4, TrKB (poly), Trop2, Tsg 101, TWEAK, UNC93A, VCAN, VEGF A, wnt-5a(C-16), XAGE, XAGE-1 |
| Prostate Vesicle Membrane | ADAM 9, ADAM10, AGR2, ALDOA, ALIX, ANXA1, ANXA2, ANXA4, ARF6, ATP1A3, B7H3, BCHE, BCL2L14 (Bcl G), BCNP1, BDKRB2, BDNFCAV1-Caveolin1, CCR2 (CC chemokine receptor 2, CD192), CCR5 (CC chemokine receptor 5), CCT2 (TCP1-beta), CD10, CD151, CD166/ALCAM, CD24, CD283/TLR3, CD41, CD46, CD49d (Integrin alpha 4, ITGA4), CD63, CD81, CD9, CD90/THY1, CDH1, CDH2, CDKN1A cyclin-dependent kinase inhibitor (p21), CGA gene (coding for the alpha subunit of glycoprotein hormones), CLDN3- Claudin3, COX2 (PTGS2), CSE1L (Cellular Apoptosis Susceptibility), CXCR3, Cytokeratin 18, Eag1 (KCNH1), EDIL3 (del-1), EDNRB—Endothelial Receptor Type B, |

TABLE 4-continued

Illustrative Biomarkers

| Illustrative Class | Biomarkers |
|---|---|
| | EGFR, EpoR, EZH2 (enhancer of Zeste Homolog2), EZR, FABP5, Farnesyltransferase/geranylgeranyl diphosphate synthase 1 (GGPS1), Fatty acid synthase (FASN), FTL (light and heavy), GAL3, GDF15—Growth Differentiation Factor 15, GloI, GM-CSF, GSTP1, H3F3A, HGF (hepatocyte growth factor), hK2/Kif2a, HSP90AA1, HSPA1A/HSP70-1, HSPB1, IGFBP-2, IGFBP-3, IL1alpha, IL-6, IQGAP1, ITGAL (Integrin alpha L chain), Ki67, KLK1, KLK10, KLK11, KLK12, KLK13, KLK14, KLK15, KLK4, KLK5, KLK6, KLK7, KLK8, KLK9, Lamp-2, LDH-A, LGALS3BP, LGALS8, MMP 1, MMP 2, MMP 25, MMP 3, MMP10, MMP-14/MT1-MMP, MMP7, MTA1nAnS, Nav1.7, NKX3-1, Notch1, NRP1/CD304, PAP (ACPP), PGP, PhIP, PIP3/BPNT1, PKM2, PKP1 (plakophilin1), PKP3 (plakophilin3), Plasma chromogranin-A (CgA), PRDX2, Prostate secretory protein (PSP94)/β-Microseminoprotein (MSP)/IGBF, PSAP, PSMA, PSMA1, PTENPTPN13/PTPL1, RPL19, seprase/FAPSET, SLC3A2/CD98, SRVN, STEAP1, Syndecan/CD138, TGFB, TGM2, TIMP-1TLR4 (CD284), TLR9 (CD289), TMPRSS1/hepsin, TMPRSS2, TNFR1, TNFα, Transferrin receptor/CD71/TRFR, Trop2 (TACSTD2), TWEAK uPA (urokinase plasminoge activator) degrades extracellular matrix, uPAR (uPA receptor)/CD87, VEGFR1, VEGFR2 |
| Prostate Vesicle Markers | ADAM 34, ADAM 9, AGR2, ALDOA, ANXA1, ANXA 11, ANXA4, ANXA 7, ANXA2, ARF6, ATP1A1, ATP1A2, ATP1A3, BCHE, BCL2L14 (Bcl G), BDKRB2, CA215, CAV1—Caveolin1, CCR2 (CC chemokine receptor 2, CD192), CCR5 (CC chemokine receptor 5), CCT2 (TCP1-beta), CD166/ALCAM, CD49b (Integrin alpha 2, ITGA4), CD90/THY1, CDH1, CDH2, CDKN1A cyclin-dependent kinase inhibitor (p21), CGA gene (coding for the alpha subunit of glycoprotein hormones), CHMP4B, CLDN3—Claudin3, CLSTN1 (Calsyntenin-1), COX2 (PTGS2), CSE1L (Cellular Apoptosis Susceptibility), Cytokeratin 18, Eag1 (KCNH1) (plasma membrane-K+-voltage gated channel), EDIL3 (del-1), EDNRB-Endothelial Receptor Type B, Endoglin/CD105, ENOX2—Ecto-NOX disulphide Thiol exchanger 2, EPCA-2 Early prostate cancer antigen2, EpoR, EZH2 (enhancer of Zeste Homolog2), EZR, FABP5, Farnesyltransferase/geranylgeranyl diphosphate synthase 1 (GGPS1), Fatty acid synthase (FASN, plasma membrane protein), FTL (light and heavy), GDF15—Growth Differentiation Factor 15, GloI, GSTP1, H3F3A, HGF (hepatocyte growth factor), hK2 (KLK2), HSP90AA1, HSPA1A/HSP70-1, IGFBP-2, IGFBP-3, IL1alpha, IL-6, IQGAP1, ITGAL (Integrin alpha L chain), Ki67, KLK1, KLK10, KLK11, KLK12, KLK13, KLK14, KLK15, KLK4, KLK5, KLK6, KLK7, KLK8, KLK9, Lamp-2, LDH-A, LGALS3BP, LGALS8, MFAP5, MMP 1, MMP 2, MMP 24, MMP 25, MMP 3, MMP10, MMP-14/MT1-MMP, MTA1, nAnS, Nav1.7, NCAM2—Neural cell Adhesion molecule 2, NGEP/D-TMPP/IPCA-5/ANO7, NKX3-1, Notch1, NRP1/CD304, PGP, PAP (ACPP), PCA3—Prostate cancer antigen 3, Pdia3/ERp57, PhIP, phosphatidylethanolamine (PE), PIP3, PKP1 (plakophilin1), PKP3 (plakophilin3), Plasma chromogranin-A (CgA), PRDX2, Prostate secretory protein (PSP94)/β-Microseminoprotein (MSP)/IGBF, PSAP, PSMA, PSMA1, PTEN, PTGFRN, PTPN13/PTPL1, PKM2, RPL19, SCA-1/ATXN1, SERINC5/TPO1, SET, SLC3A2/CD98, STEAP1, STEAP-3, SRVN, Syndecan/CD138, TGFB, Tissue Polypeptide Specific antigen TPS, TLR4 (CD284), TLR9 (CD289), TMPRSS1/hepsin, TMPRSS2, TNFR1, TNFα, CD283/TLR3, Transferrin receptor/CD71/TRFR, uPA (urokinase plasminoge activator), uPAR (uPA receptor)/CD87, VEGFR1, VEGFR2 |
| Prostate Cancer Treatment | hsa-miR-1974, hsa-miR-27b, hsa-miR-103, hsa-miR-146a, hsa-miR-22, hsa-miR-382, hsa-miR-23a, hsa-miR-376c, hsa-miR-335, hsa-miR-142-5p, hsa-miR-221, hsa-miR-142-3p, hsa-miR-151-3p, hsa-miR-21, hsa-miR-16 |
| Prostate Cancer | let-7d, miR-148a, miR-195, miR-25, miR-26b, miR-329, miR-376c, miR-574-3p, miR-888, miR-9, miR1204, miR-16-2*, miR-497, miR-588, miR-614, miR-765, miR92b*, miR-938, let-7f-2*, miR-300, miR-523, miR-525-5p, miR-1182, miR-1244, miR-520d-3p, miR-379, let-7b, miR-125a-3p, miR-1296, miR-134, miR-149, miR-150, miR-187, miR-32, miR-324-3p, miR-324-5p, miR-342-3p, miR-378, miR-378*, miR-384, miR-451, miR-455-3p, miR-485-3p, miR-487a, miR-490-3p, miR-502-5p, miR-548a-5p, miR-550, miR-562, miR-593, miR-593*, miR-595, miR-602, miR-603, miR-654-5p, miR-877*, miR-886-5p, miR-125a-5p, miR-140-3p, miR-192, miR-196a, miR-2110, miR-212, miR-222, miR-224*, miR-30b*, miR-499-3p, miR-505* |
| Prostate (PCSA + cMVs) | miR-182, miR-663, miR-155, mirR-125a-5p, miR-548a-5p, miR-628-5p, miR-517*, miR-450a, miR-920, hsa-miR-619, miR-1913, miR-224*, miR-502-5p, miR-888, miR-376a, miR-542-5p, miR-30b*, miR-1179 |
| Prostate Cancer | miR-183-96-182 cluster (miRs-183, 96 and 182), metal ion transporter such as hZIP1, SLC39A1, SLC39A2, SLC39A3, SLC39A4, SLC39A5, SLC39A6, SLC39A7, SLC39A8, SLC39A9, SLC39A10, SLC39A11, SLC39A12, SLC39A13, SLC39A14 |
| Prostate Cancer | RAD23B, FBP1, TNFRSF1A, CCNG2, NOTCH3, ETV1, BID, SIM2, LETMD1, ANXA1, miR-519d,miR-647 |
| Prostate Cancer | RAD23B, FBP1, TNFRSF1A, NOTCH3, ETV1, BID, SIM2, ANXA1, BCL2 |
| Prostate Cancer | ANPEP, ABL1, PSCA, EFNA1, HSPB1, INMT, TRIP13 |
| Prostate Cancer | E2F3, c-met, pRB, EZH2, e-cad, CAXII, CAIX, HIF-1α, Jagged, PIM-1, hepsin, RECK, Clusterin, MMP9, MTSP-1, MMP24, MMP15, IGFBP-2, IGFBP-3, E2F4, caveolin, EF-1A, Kallikrein 2, Kallikrein 3, PSGR |
| Prostate Cancer | A2ML1, BAX, C10orf47, C1orf162, CSDA, EIFC3, ETFB, GABARAPL2, GUK1, GZMH, HIST1H3B, HLA-A, HSP90AA1, NRGN, PRDX5, PTMA, RABAC1, RABAGAP1L, RPL22, SAP18, SEPW1, SOX1 |
| Prostate Cancer | NY-ESO-1, SSX-2, SSX-4, XAGE-lb, AMACR, p90 autoantigen, LEDGF |
| Prostate Cancer | A33, ABL2, ADAM10, AFP, ALA, ALIX, ALPL, ApoJ/CLU, ASCA, ASPH(A-10), ASPH(D01P), AURKB, B7H3, B7H3, B7H4, BCNP, BDNF, CA125(MUC16), CA-19-9, C-Bir, CD10, CD151, CD24, CD41, CD44, CD46, CD59(MEM-43), CD63, CD63, CD66eCEA, CD81, CD81, CD9, CD9, CDA, CDADC1, CRMP-2, CRP, CXCL12, CXCR3, |

TABLE 4-continued

Illustrative Biomarkers

| Illustrative Class | Biomarkers |
|---|---|
| | CYFRA21-1, DDX-1, DLL4, DLL4, EGFR, Epcam, EphA2, ErbB2, ERG, EZH2, FASL, FLNA, FRT, GAL3, GATA2, GM-CSF, Gro-alpha, HAP, HER3(ErbB3), HSP70, HSPB1, hVEGFR2, iC3b, IL-1B, IL6R, IL6Unc, IL7Ralpha/CD127, IL8, INSIG-2, Integrin, KLK2, LAMN, Mammoglobin, M-CSF, MFG-E8, MIF, MISRII, MMP7, MMP9, MUC1, Muc1, MUC17, MUC2, Ncam, NDUFB7, NGAL, NK-2R(C-21), NT5E (CD73), p53, PBP, PCSA, PCSA, PDGFRB, PIM1, PRL, PSA, PSA, PSMA, PSMA, RAGE, RANK, RegIV, RUNX2, S100-A4, seprase/FAP, SERPINB3, SIM2(C-15), SPARC, SPC, SPDEF, SPP1, STEAP, STEAP4, TFF3, TGM2, TIMP-1, TMEM211, Trail-R2, Trail-R4, TrKB(poly), Trop2, Tsg101, TWEAK, UNC93A, VEGFA, wnt-5a(C-16) |
| Prostate Vesicles | CD9, CD63, CD81, PCSA, MUC2, MFG-E8 |
| Prostate Cancer | miR-148a, miR-329, miR-9, miR-378*, miR-25, miR-614, miR-518c*, miR-378, miR-765, let-7f-2*, miR-574-3p, miR-497, miR-32, miR-379, miR-520g, miR-542-5p, miR-342-3p, miR-1206, miR-663, miR-222 |
| Prostate Cancer | hsa-miR-877*, hsa-miR-593, hsa-miR-595, hsa-miR-300, hsa-miR-324-5p, hsa-miR-548a-5p, hsa-miR-329, hsa-miR-550, hsa-miR-886-5p, hsa-miR-603, hsa-miR-490-3p, hsa-miR-938, hsa-miR-149, hsa-miR-150, hsa-miR-1296, hsa-miR-384, hsa-miR-487a, hsa-miRPlus-C1089, hsa-miR-485-3p, hsa-miR-525-5p |
| Prostate Cancer | hsa-miR-451, hsa-miR-223, hsa-miR-593*, hsa-miR-1974, hsa-miR-486-5p, hsa-miR-19b, hsa-miR-320b, hsa-miR-92a, hsa-miR-21, hsa-miR-675*, hsa-miR-16, hsa-miR-876-5p, hsa-miR-144, hsa-miR-126, hsa-miR-137, hsa-miR-1913, hsa-miR-29b-1*, hsa-miR-15a, hsa-miR-93, hsa-miR-1266 |
| Inflammatory Disease | miR-588, miR-1258, miR-16-2*, miR-938, miR-526b, miR-92b*, let-7d, miR-378*, miR-124, miR-376c, miR-26b, miR-1204, miR-574-3p, miR-195, miR-499-3p, miR-2110, miR-888 |
| Prostate Cancer | A33, ADAM10, AMACR, ASPH (A-10), AURKB, B7H3, CA125, CA-19-9, C-Bir, CD24, CD3, CD41, CD63, CD66e CEA, CD81, CD9, CDADC1, CSA, CXCL12, DCRN, EGFR, EphA2, ERG, FLNA, FRT, GAL3, GM-CSF, Gro-alpha, HER 3 (ErbB3), hVEGFR2, IL6 Unc, Integrin, Mammaglobin, MFG-E8, MMP9, MUC1, MUC17, MUC2, NGAL, NK-2R(C-21), NY-ESO-1, PBP, PCSA, PIM1, PRL, PSA, PSIP1/LEDGF, PSMA, RANK, S100-A4, seprase/FAP, SIM2 (C-15), SPDEF, SSX2, STEAP, TGM2, TIMP-1, Trail-R4, Tsg 101, TWEAK, UNC93A, VCAN, XAGE-1 |
| Prostate Cancer | A33, ADAM10, ALIX, AMACR, ASCA, ASPH (A-10), AURKB, B7H3, BCNP, CA125, CA-19-9, C-Bir (Flagellin), CD24, CD3, CD41, CD63, CD66e CEA, CD81, CD9, CDADC1, CRP, CSA, CXCL12, CYFRA21-1, DCRN, EGFR, EpCAM, EphA2, ERG, FLNA, GAL3, GATA2, GM-CSF, Gro alpha, HER3 (ErbB3), HSP70, hVEGFR2, iC3b, IL-1B, IL6 Unc, IL8, Integrin, KLK2, Mammaglobin, MFG-E8, MMP7, MMP9, MS4A1, MUC1, MUC17, MUC2, NGAL, NK-2R(C-21), NY-ESO-1, p53, PBP, PCSA, PIM1, PRL, PSA, PSMA, RANK, RUNX2, S100-A4, seprase/FAP, SERPINB3, SIM2 (C-15), SPC, SPDEF, SSX2, SSX4, STEAP, TGM2, TIMP-1, TRAIL R2, Trail-R4, Tsg 101, TWEAK, VCAN, VEGF A, XAGE |
| Prostate Vesicles | EpCam, CD81, PCSA, MUC2, MFG-E8 |
| Prostate Vesicles | CD9, CD63, CD81, MMP7, EpCAM |
| Prostate Cancer | let-7d, miR-148a, miR-195, miR-25, miR-26b, miR-329, miR-376c, miR-574-3p, miR-888, miR-9, miR1204, miR-16-2*, miR-497, miR-588, miR-614, miR-765, miR92b*, miR-938, let-7f-2*, miR-300, miR-523, miR-525-5p, miR-1182, miR-1244, miR-520d-3p, miR-379, let-7b, miR-125a-3p, miR-1296, miR-134, miR-149, miR-150, miR-187, miR-32, miR-324-3p, miR-324-5p, miR-342-3p, miR-378, miR-378*, miR-384, miR-451, miR-455-3p, miR-485-3p, miR-487a, miR-490-3p, miR-502-5p, miR-548a-5p, miR-550, miR-562, miR-593, miR-593*, miR-595, miR-602, miR-603, miR-654-5p, miR-877*, miR-886-5p, miR-125a-5p, miR-140-3p, miR-192, miR-196a, miR-2110, miR-212, miR-222, miR-224*, miR-30b*, miR-499-3p, miR-505* |
| Prostate Cancer | STAT3, EZH2, p53, MACC1, SPDEF, RUNX2, YB-1, AURKA, AURKB |
| Prostate Cancer (Ensembl ENSG identifiers) | E.001036, E.001497, E.001561, E.002330, E.003402, E.003756, E.004838, E.005471, E.005882, E.005893, E.006210, E.006453, E.006625, E.006695, E.006756, E.007264, E.007952, E.008118, E.008196, E.009694, E.009830, E.010244, E.010256, E.010278, E.010539, E.010810, E.011052, E.011114, E.011143, E.011304, E.011451, E.012061, E.012779, E.014216, E.014257, E.015133, E.015171, E.015479, E.015676, E.016402, E.018189, E.018699, E.020922, E.022976, E.023909, E.026508, E.026559, E.029363, E.029725, E.030582, E.033030, E.035141, E.036257, E.036448, E.038002, E.039068, E.039560, E.041353, E.044115, E.047410, E.047597, E.048544, E.048828, E.049239, E.049246, E.049883, E.051596, E.051620, E.052795, E.053108, E.054118, E.054938, E.056097, E.057252, E.057608, E.058729, E.059122, E.059378, E.059691, E.060339, E.060688, E.061794, E.061918, E.062485, E.063241, E.063244, E.064201, E.064489, E.064655, E.064886, E.065054, E.065057, E.065308, E.065427, E.065457, E.065485, E.065526, E.065548, E.065978, E.066455, E.066557, E.067248, E.067369, E.067704, E.068724, E.068885, E.069535, E.069712, E.069849, E.069869, E.069956, E.070501, E.070785, E.070814, E.071246, E.071626, E.071859, E.072042, E.072071, E.072110, E.072506, E.073050, E.073350, E.073584, E.073756, E.074047, E.074071, E.074964, E.075131, E.075239, E.075624, E.075651, E.075711, E.075856, E.075886, E.076043, E.076248, E.076554, E.076864, E.077097, E.077147, E.077312, E.077514, E.077522, E.078269, E.078295, E.078808, E.078902, E.079246, E.079313, E.079785, E.080572, E.080823, E.081087, E.081138, E.081181, E.081721, E.081842, E.082212, E.082258, E.082556, E.083093, E.083720, E.084234, E.084463, E.085224, E.085733, E.086062, E.086205, E.086717, E.087087, E.087301, E.088888, E.088899, E.088930, E.088992, E.089048, E.089127, E.089154, E.089177, E.089248, E.089280, E.089902, E.090013, E.090060, E.090565, E.090612, E.090615, E.090674, E.090861, E.090889, E.091140, |

TABLE 4-continued

Illustrative Biomarkers

| Illustrative Class | Biomarkers |
|---|---|
| | E.091483, E.091542, E.091732, E.092020, E.092199, E.092421, E.092621, E.092820, E.092871, E.092978, E.093010, E.094755, E.095139, E.095380, E.095485, E.095627, E.096060, E.096384, E.099331, E.099715, E.099783, E.099785, E.099800, E.099821, E.099899, E.099917, E.099956, E.100023, E.100056, E.100065, E.100084, E.100142, E.100191, E.100216, E.100242, E.100271, E.100284, E.100299, E.100311, E.100348, E.100359, E.100393, E.100399, E.100401, E.100412, E.100442, E.100575, E.100577, E.100583, E.100601, E.100603, E.100612, E.100632, E.100714, E.100739, E.100796, E.100802, E.100815, E.100823, E.100836, E.100883, E.101057, E.101126, E.101152, E.101222, E.101246, E.101265, E.101365, E.101439, E.101557, E.101639, E.101654, E.101811, E.101812, E.101901, E.102030, E.102054, E.102103, E.102158, E.102174, E.102241, E.102290, E.102316, E.102362, E.102384, E.102710, E.102780, E.102904, E.103035, E.103067, E.103175, E.103194, E.103449, E.103479, E.103591, E.103599, E.103855, E.103978, E.104064, E.104067, E.104131, E.104164, E.104177, E.104228, E.104331, E.104365, E.104419, E.104442, E.104611, E.104626, E.104723, E.104760, E.104805, E.104812, E.104823, E.104824, E.105127, E.105220, E.105221, E.105281, E.105379, E.105402, E.105404, E.105409, E.105419, E.105428, E.105486, E.105514, E.105518, E.105618, E.105705, E.105723, E.105939, E.105948, E.106049, E.106078, E.106128, E.106153, E.106346, E.106392, E.106554, E.106565, E.106603, E.106633, E.107104, E.107164, E.107404, E.107485, E.107551, E.107581, E.107623, E.107798, E.107816, E.107833, E.107890, E.107897, E.107968, E.108296, E.108312, E.108375, E.108387, E.108405, E.108417, E.108465, E.108561, E.108582, E.108639, E.108641, E.108848, E.108883, E.108953, E.109062, E.109184, E.109572, E.109625, E.109758, E.109790, E.109814, E.109846, E.109956, E.110063, E.110066, E.110104, E.110107, E.110321, E.110328, E.110921, E.110955, E.111057, E.111218, E.111261, E.111335, E.111540, E.111605, E.111647, E.111785, E.111790, E.111801, E.111907, E.112039, E.112081, E.112096, E.112110, E.112144, E.112232, E.112234, E.112473, E.112578, E.112584, E.112715, E.112941, E.113013, E.113163, E.113282, E.113368, E.113441, E.113448, E.113522, E.113580, E.113645, E.113719, E.113739, E.113790, E.114054, E.114127, E.114302, E.114331, E.114388, E.114491, E.114861, E.114867, E.115053, E.115221, E.115234, E.115239, E.115241, E.115257, E.115339, E.115540, E.115541, E.115561, E.115604, E.115648, E.115738, E.115758, E.116044, E.116096, E.116127, E.116254, E.116288, E.116455, E.116478, E.116604, E.116649, E.116726, E.116754, E.116833, E.117298, E.117308, E.117335, E.117362, E.117411, E.117425, E.117448, E.117480, E.117592, E.117593, E.117614, E.117676, E.117713, E.117748, E.117751, E.117877, E.118181, E.118197, E.118260, E.118292, E.118513, E.118523, E.118640, E.118898, E.119121, E.119138, E.119318, E.119321, E.119335, E.119383, E.119421, E.119636, E.119681, E.119711, E.119820, E.119888, E.119906, E.120159, E.120328, E.120337, E.120370, E.120656, E.120733, E.120837, E.120868, E.120915, E.120948, E.121022, E.121057, E.121068, E.121104, E.121390, E.121671, E.121690, E.121749, E.121774, E.121879, E.121892, E.121903, E.121940, E.121957, E.122025, E.122033, E.122126, E.122507, E.122566, E.122705, E.122733, E.122870, E.122884, E.122952, E.123066, E.123080, E.123143, E.123154, E.123178, E.123416, E.123427, E.123595, E.123901, E.123908, E.123983, E.123992, E.124143, E.124164, E.124181, E.124193, E.124216, E.124232, E.124529, E.124562, E.124570, E.124693, E.124749, E.124767, E.124788, E.124795, E.124831, E.124942, E.125246, E.125257, E.125304, E.125352, E.125375, E.125445, E.125492, E.125676, E.125753, E.125798, E.125844, E.125868, E.125901, E.125944, E.125995, E.126062, E.126267, E.126653, E.126773, E.126777, E.126814, E.126858, E.126883, E.126934, E.126945, E.126952, E.127022, E.127328, E.127329, E.127399, E.127415, E.127554, E.127616, E.127720, E.127824, E.127884, E.127914, E.127946, E.127948, E.128050, E.128311, E.128342, E.128609, E.128626, E.128683, E.128708, E.128881, E.129315, E.129351, E.129355, E.129514, E.129636, E.129657, E.129757, E.129810, E.129990, E.130175, E.130177, E.130193, E.130255, E.130299, E.130305, E.130338, E.130340, E.130402, E.130413, E.130612, E.130713, E.130764, E.130770, E.130810, E.130826, E.130935, E.131351, E.131467, E.131473, E.131771, E.131773, E.132002, E.132275, E.132323, E.132382, E.132475, E.132481, E.132589, E.132646, E.132716, E.132881, E.133313, E.133315, E.133687, E.133835, E.133863, E.133874, E.133961, E.134077, E.134138, E.134207, E.134248, E.134308, E.134444, E.134452, E.134548, E.134684, E.134759, E.134809, E.134851, E.134955, E.135052, E.135297, E.135298, E.135387, E.135390, E.135476, E.135486, E.135525, E.135597, E.135679, E.135740, E.135829, E.135842, E.135870, E.135900, E.135914, E.135926, E.135940, E.135999, E.136044, E.136068, E.136152, E.136169, E.136280, E.136371, E.136383, E.136450, E.136521, E.136527, E.136574, E.136710, E.136750, E.136807, E.136874, E.136875, E.136930, E.136933, E.136935, E.137055, E.137124, E.137312, E.137409, E.137497, E.137513, E.137558, E.137601, E.137727, E.137776, E.137806, E.137814, E.137815, E.137948, E.137955, E.138028, E.138031, E.138041, E.138050, E.138061, E.138069, E.138073, E.138095, E.138160, E.138294, E.138347, E.138363, E.138385, E.138587, E.138594, E.138621, E.138674, E.138756, E.138757, E.138760, E.138772, E.138796, E.139211, E.139405, E.139428, E.139517, E.139613, E.139626, E.139684, E.139697, E.139874, E.140263, E.140265, E.140326, E.140350, E.140374, E.140382, E.140451, E.140481, E.140497, E.140632, E.140678, E.140694, E.140743, E.140932, E.141002, E.141012, E.141258, E.141378, E.141425, E.141429, E.141522, E.141543, E.141639, E.141744, E.141873, E.141994, E.142025, E.142208, E.142515, E.142606, E.142698, E.142765, E.142864, E.142875, E.143013, E.143294, E.143321, E.143353, E.143374, E.143375, E.143390, E.143578, E.143614, E.143621, E.143633, E.143771, E.143797, E.143816, E.143889, E.143924, E.143933, E.143947, E.144136, E.144224, E.144306, E.144381, E.144410, E.144485, E.144566, E.144671, |

TABLE 4-continued

Illustrative Biomarkers

| Illustrative Class | Biomarkers |
|---|---|
| | E.144741, E.144935, E.145020, E.145632, E.145741, E.145833, E.145888, E.145907, E.145908, E.145919, E.145990, E.146067, E.146070, E.146281, E.146433, E.146457, E.146535, E.146701, E.146856, E.146966, E.147044, E.147127, E.147130, E.147133, E.147140, E.147231, E.147257, E.147403, E.147475, E.147548, E.147697, E.147724, E.148158, E.148396, E.148488, E.148672, E.148737, E.148835, E.149182, E.149218, E.149311, E.149480, E.149548, E.149646, E.150051, E.150593, E.150961, E.150991, E.151092, E.151093, E.151247, E.151304, E.151491, E.151690, E.151715, E.151726, E.151779, E.151806, E.152086, E.152207, E.152234, E.152291, E.152359, E.152377, E.152409, E.152422, E.152582, E.152763, E.152818, E.152942, E.153113, E.153140, E.153391, E.153904, E.153936, E.154099, E.154127, E.154380, E.154639, E.154723, E.154781, E.154832, E.154864, E.154889, E.154957, E.155368, E.155380, E.155508, E.155660, E.155714, E.155959, E.155980, E.156006, E.156194, E.156282, E.156304, E.156467, E.156515, E.156603, E.156650, E.156735, E.156976, E.157064, E.157103, E.157502, E.157510, E.157538, E.157551, E.157637, E.157764, E.157827, E.157992, E.158042, E.158290, E.158321, E.158485, E.158545, E.158604, E.158669, E.158715, E.158747, E.158813, E.158863, E.158901, E.158941, E.158987, E.159147, E.159184, E.159348, E.159363, E.159387, E.159423, E.159658, E.159692, E.159761, E.159921, E.160049, E.160226, E.160285, E.160294, E.160633, E.160685, E.160691, E.160789, E.160862, E.160867, E.160948, E.160972, E.161202, E.161267, E.161649, E.161692, E.161714, E.161813, E.161939, E.162069, E.162298, E.162385, E.162437, E.162490, E.162613, E.162641, E.162694, E.162910, E.162975, E.163041, E.163064, E.163110, E.163257, E.163468, E.163492, E.163530, E.163576, E.163629, E.163644, E.163749, E.163755, E.163781, E.163825, E.163913, E.163923, E.163930, E.163932, E.164045, E.164051, E.164053, E.164163, E.164244, E.164270, E.164300, E.164309, E.164442, E.164488, E.164520, E.164597, E.164749, E.164754, E.164828, E.164916, E.164919, E.164924, E.165084, E.165119, E.165138, E.165215, E.165259, E.165264, E.165280, E.165359, E.165410, E.165496, E.165637, E.165646, E.165661, E.165688, E.165695, E.165699, E.165792, E.165807, E.165813, E.165898, E.165923, E.165934, E.166263, E.166266, E.166329, E.166337, E.166341, E.166484, E.166526, E.166596, E.166598, E.166710, E.166747, E.166833, E.166860, E.166946, E.166971, E.167004, E.167085, E.167110, E.167113, E.167258, E.167513, E.167552, E.167553, E.167604, E.167635, E.167642, E.167658, E.167699, E.167744, E.167751, E.167766, E.167772, E.167799, E.167815, E.167969, E.167978, E.167987, E.167996, E.168014, E.168036, E.168066, E.168071, E.168148, E.168298, E.168393, E.168575, E.168653, E.168746, E.168763, E.168769, E.168803, E.168916, E.169087, E.169093, E.169122, E.169189, E.169213, E.169242, E.169410, E.169418, E.169562, E.169592, E.169612, E.169710, E.169763, E.169789, E.169807, E.169826, E.169957, E.170017, E.170027, E.170037, E.170088, E.170144, E.170275, E.170310, E.170315, E.170348, E.170374, E.170381, E.170396, E.170421, E.170430, E.170445, E.170549, E.170632, E.170703, E.170743, E.170837, E.170854, E.170906, E.170927, E.170954, E.170959, E.171121, E.171155, E.171180, E.171202, E.171262, E.171302, E.171345, E.171428, E.171488, E.171490, E.171492, E.171540, E.171643, E.171680, E.171723, E.171793, E.171861, E.171953, E.172115, E.172283, E.172345, E.172346, E.172466, E.172590, E.172594, E.172653, E.172717, E.172725, E.172733, E.172831, E.172867, E.172893, E.172939, E.173039, E.173230, E.173366, E.173473, E.173540, E.173585, E.173599, E.173714, E.173726, E.173805, E.173809, E.173826, E.173889, E.173898, E.173905, E.174021, E.174100, E.174332, E.174842, E.174996, E.175063, E.175110, E.175166, E.175175, E.175182, E.175198, E.175203, E.175216, E.175220, E.175334, E.175416, E.175602, E.175866, E.175946, E.176102, E.176105, E.176155, E.176171, E.176371, E.176515, E.176900, E.176971, E.176978, E.176994, E.177156, E.177239, E.177354, E.177409, E.177425, E.177459, E.177542, E.177548, E.177565, E.177595, E.177628, E.177674, E.177679, E.177694, E.177697, E.177731, E.177752, E.177951, E.178026, E.178078, E.178104, E.178163, E.178175, E.178187, E.178234, E.178381, E.178473, E.178741, E.178828, E.178950, E.179091, E.179115, E.179119, E.179348, E.179388, E.179776, E.179796, E.179869, E.179912, E.179981, E.180035, E.180198, E.180287, E.180318, E.180667, E.180869, E.180979, E.180998, E.181072, E.181163, E.181222, E.181234, E.181513, E.181523, E.181610, E.181773, E.181873, E.181885, E.181924, E.182013, E.182054, E.182217, E.182271, E.182318, E.182319, E.182512, E.182732, E.182795, E.182872, E.182890, E.182944, E.183048, E.183092, E.183098, E.183128, E.183207, E.183292, E.183431, E.183520, E.183684, E.183723, E.183785, E.183831, E.183856, E.184007, E.184047, E.184113, E.184156, E.184254, E.184363, E.184378, E.184470, E.184481, E.184508, E.184634, E.184661, E.184697, E.184708, E.184735, E.184840, E.184916, E.185043, E.185049, E.185122, E.185219, E.185359, E.185499, E.185554, E.185591, E.185619, E.185736, E.185860, E.185896, E.185945, E.185972, E.186198, E.186205, E.186376, E.186472, E.186575, E.186591, E.186660, E.186814, E.186834, E.186868, E.186889, E.187097, E.187323, E.187492, E.187634, E.187764, E.187792, E.187823, E.187837, E.187840, E.188021, E.188171, E.188186, E.188739, E.188771, E.188846, E.189060, E.189091, E.189143, E.189144, E.189221, E.189283, E.196236, E.196419, E.196436, E.196497, E.196504, E.196526, E.196591, E.196700, E.196743, E.196796, E.196812, E.196872, E.196975, E.196993, E.197081, E.197157, E.197217, E.197223, E.197299, E.197323, E.197353, E.197451, E.197479, E.197746, E.197779, E.197813, E.197837, E.197857, E.197872, E.197969, E.197976, E.198001, E.198033, E.198040, E.198087, E.198131, E.198156, E.198168, E.198205, E.198216, E.198231, E.198265, E.198366, E.198431, E.198455, E.198563, E.198586, E.198589, E.198712, E.198721, E.198732, E.198783, E.198793, E.198804, E.198807, E.198824, E.198841, E.198951, E.203301, |

TABLE 4-continued

Illustrative Biomarkers

| Illustrative Class | Biomarkers |
|---|---|
| | E.203795, E.203813, E.203837, E.203879, E.203908, E.204231, E.204316, E.204389, E.204406, E.204560, E.204574 |
| Prostate Markers (Ensembl ENSG identifiers) | E.005893 (LAMP2), E.006756 (ARSD), E.010539 (ZNF200), E.014257 (ACPP), E.015133 (CCDC88C), E.018699 (TTC27), E.044115 (CTNNA1), E.048828 (FAM120A), E.051620 (HEBP2), E.056097 (ZFR), E.060339 (CCAR1), E.063241 (ISOC2), E.064489 (MEF2BNB-MEF2B), E.064886 (CHI3L2), E.066455 (GOLGA5), E.069535 (MAOB), E.072042 (RDH11), E.072071 (LPHN1), E.074047 (GLI2), E.076248 (UNG), E.076554 (TPD52), E.077147 (TM9SF3), E.077312 (SNRPA), E.081842 (PCDHA6), E.086717 (PPEF1), E.088888 (MAVS), E.088930 (XRN2), E.089902 (RCOR1), E.090612 (ZNF268), E.092199 (HNRNPC), E.095380 (NANS), E.099783 (HNRNPM), E.100191 (SLC5A4), E.100216 (TOMM22), E.100242 (SUN2), E.100284 (TOM1), E.100401 (RANGAP1), E.100412 (ACO2), E.100836 (PABPN1), E.102054 (RBBP7), E.102103 (PQBP1), E.103599 (IQCH), E.103978 (TMEM87A), E.104177 (MYEF2), E.104228 (TRIM35), E.105428 (ZNRF4), E.105518 (TMEM205), E.106603 (C7orf44; COA1), E.108405 (P2RX1), E.111057 (KRT18), E.111218 (PRMT8), E.112081 (SRSF3), E.112144 (ICK), E.113013 (HSPA9), E.113368 (LMNB1), E.115221 (ITGB6), E.116096 (SPR), E.116754 (SRSF11), E.118197 (DDX59), E.118898 (PPL), E.119121 (TRPM6), E.119711 (ALDH6A1), E.120656 (TAF12), E.121671 (CRY2), E.121774 (KHDRBS1), E.122126 (OCRL), E.122566 (HNRNPA2B1), E.123901 (GPR83), E.124562 (SNRPC), E.124788 (ATXN1), E.124795 (DEK), E.125246 (CLYBL), E.126883 (NUP214), E.127616 (SMARCA4), E.127884 (ECHS1), E.128050 (PAICS), E.129351 (ILF3), E.129757 (CDKN1C), E.130338 (TULP4), E.130612 (CYP2G1P), E.131351 (HAUS8), E.131467 (PSME3), E.133315 (MACROD1), E.134452 (FBXO18), E.134851 (TMEM165), E.135940 (COX5B), E.136169 (SETDB2), E.136807 (CDK9), E.137727 (ARHGAP20), E.138031 (ADCY3), E.138050 (THUMPD2), E.138069 (RAB1A), E.138594 (TMOD3), E.138760 (SCARB2), E.138796 (HADH), E.139613 (SMARCC2), E.139684 (ESD), E.140263 (SORD), E.140350 (ANP32A), E.140632 (GLYR1), E.142765 (SYTL1), E.143621 (ILF2), E.143933 (CALM2), E.144410 (CPO), E.147127 (RAB41), E.151304 (SRFBP1), E.151806 (GUF1), E.152207 (CYSLTR2), E.152234 (ATP5A1), E.152291 (TGOLN2), E.154723 (ATP5J), E.156467 (UQCRB), E.159387 (IRX6), E.159761 (C16orf86), E.161813 (LARP4), E.162613 (FUBP1), E.162694 (EXTL2), E.165264 (NDUFB6), E.167113 (COQ4), E.167513 (CDT1), E.167772 (ANGPTL4), E.167978 (SRRM2), E.168916 (ZNF608), E.169763 (PRYP3), E.169789 (PRY), E.169807 (PRY2), E.170017 (ALCAM), E.170144 (HNRNPA3), E.170310 (STX8), E.170954 (ZNF415), E.170959 (DCDC5), E.171302 (CANT1), E.171643 (S100Z), E.172283 (PRYP4), E.172590 (MRPL52), E.172867 (KRT2), E.173366 (TLR9), E.173599 (PC), E.177595 (PIDD), E.178473 (UCN3), E.179981 (TSHZ1), E.181163 (NPM1), E.182319 (Tyrosine-protein kinase SgK223), E.182795 (C1orf116), E.182944 (EWSR1), E.183092 (BEGAIN), E.183098 (GPC6), E.184254 (ALDH1A3), E.185619 (PCGF3), E.186889 (TMEM17), E.187837 (HIST1H1C), E.188771 (C11orf34), E.189060 (H1F0), E.196419 (XRCC6), E.196436 (NPIPL2), E.196504 (PRPF40A), E.196796, E.196993, E.197451 (HNRNPAB), E.197746 (PSAP), E.198131 (ZNF544), E.198156, E.198732 (SMOC1), E.198793 (MTOR), E.039068 (CDH1), E.173230 (GOLGB1), E.124193 (SRSF6), E.140497 (SCAMP2), E.168393 (DTYMK), E.184708 (EIF4ENIF1), E.124164 (VAPB), E.125753 (VASP), E.118260 (CREB1), E.135052 (GOLM1), E.010244 (ZNF207), E.010278 (CD9), E.047597 (XK), E.049246 (PER3), E.069849 (ATP1B3), E.072506 (HSD17B10), E.081138 (CDH7), E.099785 (MARCH2), E.104331 (IMPAD1), E.104812 (GYS1), E.120868 (APAF1), E.123908 (EIF2C2), E.125492 (BARHL1), E.127328 (RAB3IP), E.127329 (PTPRB), E.129514 (FOXA1), E.129657 (SEC14L1), E.129990 (SYT5), E.132881 (RSG1), E.136521 (NDUFB5), E.138347 (MYPN), E.141429 (GALNT1), E.144566 (RAB5A), E.151715 (TMEM45B), E.152582 (SPEF2), E.154957 (ZNF18), E.162385 (MAGOH), E.165410 (CFL2), E.168298 (HIST1H1E), E.169418 (NPR1), E.178187 (ZNF454), E.178741 (COX5A), E.179115 (FARSA), E.182732 (RGS6), E.183431 (SF3A3), E.185049 (WHSC2), E.196236 (XPNPEP3), E.197217 (ENTPD4), E.197813, E.203301, E.116833 (NR5A2), E.121057 (AKAP1), E.005471 (ABCB4), E.071859 (FAM50A), E.084234 (APLP2), E.101222 (SPEF1), E.103175 (WFDC1), E.103449 (SALL1), E.104805 (NUCB1), E.105514 (RAB3D), E.107816 (LZTS2), E.108375 (RNF43), E.109790 (KLHL5), E.112039 (FANCE), E.112715 (VEGFA), E.121690 (DEPDC7), E.125352 (RNF113A), E.134548 (C12orG9), E.136152 (COG3), E.143816 (WNT9A), E.147130 (ZMYM3), E.148396 (SEC16A), E.151092 (NGLY1), E.151779 (NBAS), E.155508 (CNOT8), E.163755 (HPS3), E.166526 (ZNF3), E.172733 (PURG), E.176371 (ZSCAN2), E.177674 (AGTRAP), E.181773 (GPR3), E.183048 (SLC25A10; MRPL12 SLC25A10), E.186376 (ZNF75D), E.187323 (DCC), E.198712 (MT-CO2), E.203908 (C6orf221; KHDC3L), E.001497 (LAS1L), E.009694 (ODZ1), E.080572 (CXorf41; PIH1D3), E.083093 (PALB2), E.089048 (ESF1), E.100065 (CARD10), E.100739 (BDKRB1), E.102904 (TSNAXIP1), E.104824 (HNRNPL), E.107404 (DVL1), E.110066 (SUV420H1), E.120328 (PCDHB12), E.121903 (ZSCAN20), E.122025 (FLT3), E.136930 (PSMB7), E.142025 (DMRTC2), E.144136 (SLC20A1), E.146535 (GNA12), E.147140 (NONO), E.153391 (INO80C), E.164919 (COX6C), E.171540 (OTP), E.177951 (BET1L), E.179796 (LRRC3B), E.197479 (PCDHB11), E.198804 (MT-CO1), E.086205 (FOLH1), E.100632 (ERH), E.100796 (SMEK1), E.104760 (FGL1), E.114302 (PRKAR2A), E.130299 (GTPBP3), E.133961 (NUMB), E.144485 (HES6), E.167085 (PHB), E.167635 (ZNF146), E.177239 (MAN1B1), E.184481 (FOXO4), E.188171 (ZNF626), E.189221 (MAOA), E.157637 (SLC38A10), E.100883 (SRP54), E.105618 (PRPF31), E.119421 (NDUFA8), E.170837 (GPR27), E.168148 (HIST3H3), E.135525 (MAP7), E.174996 (KLC2), E.018189 (RUFY3), E.183520 (UTP11L), E.173905 (GOLIM4), E.165280 (VCP), E.022976 (ZNF839), E.059691 (PET112), E.063244 (U2AF2), E.075651 (PLD1), E.089177 (KIF16B), E.089280 (FUS), |

TABLE 4-continued

Illustrative Biomarkers

| Illustrative Class | Biomarkers |
|---|---|
| | E.094755 (GABRP), E.096060 (FKBP5), E.100023 (PPIL2), E.100359 (SGSM3), E.100612 (DHRS7), E.104131 (EIF3J), E.104419 (NDRG1), E.105409 (ATP1A3), E.107623 (GDF10), E.111335 (OAS2), E.113522 (RAD50), E.115053 (NCL), E.120837 (NFYB), E.122733 (KIAA1045), E.123178 (SPRYD7), E.124181 (PLCG1), E.126858 (RHOT1), E.128609 (NDUFA5), E.128683 (GAD1), E.130255 (RPL36), E.133874 (RNF122), E.135387 (CAPRIN1), E.135999 (EPC2), E.136383 (ALPK3), E.139405 (C12orf52), E.141012 (GALNS), E.143924 (EML4), E.144671 (SLC22A14), E.145741 (BTF3), E.145907 (G3BP1), E.149311 (ATM), E.153113 (CAST), E.157538 (DSCR3), E.157992 (KRTCAP3), E.158901 (WFDC8), E.165259 (HDX), E.169410 (PTPN9), E.170421 (KRT8), E.171155 (C1GALT1C1), E.172831 (CES2), E.173726 (TOMM20), E.176515, E.177565 (TBL1XR1), E.177628 (GBA), E.179091 (CYC1), E.189091 (SF3B3), E.197299 (BLM), E.197872 (FAM49A), E.198205 (ZXDA), E.198455 (ZXDB), E.082212 (ME2), E.109956 (B3GAT1), E.169710 (FASN), E.011304 (PTBP1), E.057252 (SOAT1), E.059378 (PARP12), E.082258 (CCNT2), E.087301 (TXNDC16), E.100575 (TIMM9), E.101152 (DNAJC5), E.101812 (H2BFM), E.102384 (CENPI), E.108641 (B9D1), E.119138 (KLF9), E.119820 (YIPF4), E.125995 (ROMO1), E.132323 (ILKAP), E.134809 (TIMM10), E.134955 (SLC37A2), E.135476 (ESPL1), E.136527 (TRA2B), E.137776 (SLTM), E.139211 (AMIGO2), E.139428 (MMAB), E.139874 (SSTR1), E.143321 (HDGF), E.164244 (PRRC1), E.164270 (HTR4), E.165119 (HNRNPK), E.165637 (VDAC2), E.165661 (QSOX2), E.167258 (CDK12), E.167815 (PRDX2), E.168014 (C2CD3), E.168653 (NDUFS5), E.168769 (TET2), E.169242 (EFNA1), E.175334 (BANF1), E.175416 (CLTB), E.177156 (TALDO1), E.180035 (ZNF48), E.186591 (UBE2H), E.187097 (ENTPD5), E.188739 (RBM34), E.196497 (IPO4), E.197323 (TRIM33), E.197857 (ZNF44), E.197976 (AKAP17A), E.064201 (TSPAN32), E.088992 (TESC), E.092421 (SEMA6A), E.100601 (ALKBH1), E.101557 (USP14), E.103035 (PSMD7), E.106128 (GHRHR), E.115541 (HSPE1), E.121390 (PSPC1), E.124216 (SNAI1), E.130713 (EXOSC2), E.132002 (DNAJB1), E.139697 (SBNO1), E.140481 (CCDC33), E.143013 (LMO4), E.145020 (AMT), E.145990 (GFOD1), E.146070 (PLA2G7), E.164924 (YWHAZ), E.165807 (PPP1R36), E.167751 (KLK2), E.169213 (RAB3B), E.170906 (NDUFA3), E.172725 (CORO1B), E.174332 (GLIS1), E.181924 (CHCHD8), E.183128 (CALHM3), E.204560 (DHX16), E.204574 (ABCF1), E.146701 (MDH2), E.198366 (HIST1H3A), E.081181 (ARG2), E.185896 (LAMP1), E.077514 (POLD3), E.099800 (TIMM13), E.100299 (ARSA), E.105419 (MEIS3), E.108417 (KRT37), E.113739 (STC2), E.125868 (DSTN), E.145908 (ZNF300), E.168575 (SLC20A2), E.182271 (TMIGD1), E.197223 (C1D), E.186834 (HEXIM1), E.001561 (ENPP4), E.011451 (WIZ), E.053108 (FSTL4), E.064655 (EYA2), E.065308 (TRAM2), E.075131 (TIPIN), E.081087 (OSTM1), E.092020 (PPP2R3C), E.096384 (HSP90AB1), E.100348 (TXN2), E.100577 (GSTZ1), E.100802 (C14orf93), E.101365 (IDH3B), E.101654 (RNMT), E.103067 (ESRP2), E.104064 (GABPB1), E.104823 (ECH1), E.106565 (TMEM176B), E.108561 (C1QBP), E.115257 (PCSK4), E.116127 (ALMS1), E.117411 (B4GALT2), E.119335 (SET), E.120337 (TNFSF18), E.122033 (MTIF3), E.122507 (BBS9), E.122870 (BICC1), E.130177 (CDC16), E.130193 (C8orf55; THEM6), E.130413 (STK33), E.130770 (ATPIF1), E.133687 (TMTC1), E.136874 (STX17), E.137409 (MTCH1), E.139626 (ITGB7), E.141744 (PNMT), E.145888 (GLRA1), E.146067 (FAM193B), E.146433 (TMEM181), E.149480 (MTA2), E.152377 (SPOCK1), E.152763 (WDR78), E.156976 (EIF4A2), E.157827 (FMNL2), E.158485 (CD1B), E.158863 (FAM160B2), E.161202 (DVL3), E.161714 (PLCD3), E.163064 (EN1), E.163468 (CCT3), E.164309 (CMYA5), E.164916 (FOXK1), E.165215 (CLDN3), E.167658 (EEF2), E.170549 (IRX1), E.171680 (PLEKHG5), E.178234 (GALNT11), E.179869 (ABCA13), E.179912 (R3HDM2), E.180869 (C1orf180), E.180979 (LRRC57), E.182872 (RBM10), E.183207 (RUVBL2), E.184113 (CLDN5), E.185972 (CCIN), E.189144 (ZNF573), E.197353 (LYPD2), E.197779 (ZNF81), E.198807 (PAX9), E.100442 (FKBP3), E.111790 (FGFR1OP2), E.136044 (APPL2), E.061794 (MRPS35), E.065427 (KARS), E.068885 (IFT80), E.104164 (PLDN; BLOC1S6), E.105127 (AKAP8), E.123066 (MED13L), E.124831 (LRRFIP1), E.125304 (TM9SF2), E.126934 (MAP2K2), E.130305 (NSUN5), E.135298 (BAI3), E.135900 (MRPL44), E.136371 (MTHFS), E.136574 (GATA4), E.140326 (CDAN1), E.141378 (PTRH2), E.141543 (EIF4A3), E.150961 (SEC24D), E.155368 (DBI), E.161649 (CD300LG), E.161692 (DBF4B), E.162437 (RAVER2), E.163257 (DCAF16), E.163576 (EFHB), E.163781 (TOPBP1), E.163913 (IFT122), E.164597 (COG5), E.165359 (DDX26B), E.165646 (SLC18A2), E.169592 (INO80E), E.169957 (ZNF768), E.171492 (LRRC8D), E.171793 (CTPS; CTPS1), E.171953 (ATPAF2), E.175182 (FAM131A), E.177354 (C10orf71), E.181610 (MRPS23), E.181873 (IBA57), E.187792 (ZNF70), E.187823 (ZCCHC16), E.196872 (C2orf55; KIAA1211L), E.198168 (SVIP), E.160633 (SAFB), E.177697 (CD151), E.181072 (CHRM2), E.012779 (ALOX5), E.065054 (SLC9A3R2), E.074071 (MRPS34), E.081155 (TRIP11), E.102030 (NAA10), E.106153 (CHCHD2), E.126814 (TRMT5), E.126952 (NXF5), E.136450 (SRSF1), E.136710 (CCDC115), E.137124 (ALDH1B1), E.143353 (LYPLAL1), E.162490 (C1orf187; DRAXIN), E.167799 (NUDT8), E.171490 (RSL1D1), E.173826 (KCNH6), E.173898 (SPTBN2), E.176900 (OR51T1), E.181513 (ACBD4), E.185554 (NXF2), E.185945 (NXF2B), E.108848 (LUC7L3), E.029363 (BCLAF1), E.038002 (AGA), E.108312 (UBTF), E.166341 (DCHS1), E.054118 (THRAP3), E.135679 (MDM2), E.166860 (ZBTB39), E.183684 (THOC4; ALYREF), E.004838 (ZMYND10), E.007264 (MATK), E.020922 (MRE11A), E.041353 (RAB27B), E.052795 (FNIP2), E.075711 (DLG1), E.087087 (SRRT), E.090060 (PAPOLA), E.095139 (ARCN1), E.099715 (PCDH11Y), E.100271 (TTLL1), E.101057 (MYBL2), E.101265 (RASSF2), E.101901 (ALG13), E.102290 (PCDH11X), E.103194 (USP10), E.106554 (CHCHD3), E.107833 (NPM3), E.110063 (DCPS), E.111540 (RAB5B), E.113448 (PDE4D), E.115339 (GALNT3), E.116254 (CHD5), E.117425 (PTCH2), E.117614 (SYF2), E.118181 (RPS25), E.118292 |

TABLE 4-continued

Illustrative Biomarkers

| Illustrative Class | Biomarkers |
|---|---|
| | (C1orf54), E.119318 (RAD23B), E.121022 (COPS5), E.121104 (FAM117A), E.123427 (METTL21B), E.125676 (THOC2), E.132275 (RRP8), E.137513 (NARS2), E.138028 (CGREF1), E.139517 (LNX2), E.143614 (GATAD2B), E.143889 (HNRPLL), E.145833 (DDX46), E.147403 (RPL10), E.148158 (SNX30), E.151690 (MFSD6), E.153904 (DDAH1), E.154781 (C3orf19), E.156650 (KAT6B), E.158669 (AGPAT6), E.159363 (ATP13A2), E.163530 (DPPA2), E.164749 (HNF4G), E.165496 (RPL10L), E.165688 (PMPCA), E.165792 (METTL17), E.166598 (HSP90B1), E.168036 (CTNNB1), E.168746 (C20orf62), E.170381 (SEMA3E), E.171180 (OR2M4), E.171202 (TMEM126A), E.172594 (SMPDL3A), E.172653 (C17orf66), E.173540 (GMPPB), E.173585 (CCR9), E.173809 (TDRD12), E.175166 (PSMD2), E.177694 (NAALADL2), E.178026 (FAM211B; C22orf36), E.184363 (PKP3), E.187634 (SAMD11), E.203837 (PNLIPRP3), E.169122 (FAM110B), E.197969 (VPS13A), E.136068 (FLNB), E.075856 (SART3), E.081721 (DUSP12), E.102158 (MAGT1), E.102174 (PHEX), E.102316 (MAGED2), E.104723 (TUSC3), E.105939 (ZC3HAV1), E.108883 (EFTUD2), E.110328 (GALNTL4), E.111785 (RIC8B), E.113163 (COL4A3BP), E.115604 (IL18R1), E.117362 (APH1A), E.117480 (FAAH), E.124767 (GLO1), E.126267 (COX6B1), E.130175 (PRKCSH), E.135926 (TMBIM1), E.138674 (SEC31A), E.140451 (PIF1), E.143797 (MBOAT2), E.149646 (C20orf152), E.157064 (NMNAT2), E.160294 (MCM3AP), E.165084 (C8orf34), E.166946 (CCNDBP1), E.170348 (TMED10), E.170703 (TTLL6), E.175198 (PCCA), E.180287 (PLD5), E.183292 (MIR5096), E.187492 (CDHR4), E.188846 (RPL14), E.015479 (MATR3), E.100823 (APEX1), E.090615 (GOLGA3), E.086062 (B4GALT1), E.138385 (SSB), E.140265 (ZSCAN29), E.140932 (CMTM2), E.167969 (ECI1), E.135486 (HNRNPA1), E.137497 (NUMA1), E.181523 (SGSH), E.099956 (SMARCB1), E.049883 (PTCD2), E.082556 (OPRK1), E.090674 (MCOLN1), E.107164 (FUBP3), E.108582 (CPD), E.109758 (HGFAC), E.111605 (CPSF6), E.115239 (ASB3), E.121892 (PDS5A), E.125844 (RRBP1), E.130826 (DKC1), E.132481 (TRIM47), E.135390 (ATP5G2), E.136875 (PRPF4), E.138621 (PPCDC), E.145632 (PLK2), E.150051 (MKX), E.153140 (CETN3), E.154127 (UBASH3B), E.156194 (PPEF2), E.163825 (RTP3), E.164053 (ATRIP), E.164442 (CITED2), E.168066 (SF1), E.170430 (MGMT), E.175602 (CCDC85B), E.177752 (YIPF7), E.182512 (GLRX5), E.188186 (C7orf59), E.198721 (ECI2), E.204389 (HSPA1A), E.010256 (UQCRC1), E.076043 (REXO2), E.102362 (SYTL4), E.161939 (C17orf49), E.173039 (RELA), E.014216 (CAPN1), E.054938 (CHRDL2), E.065526 (SPEN), E.070501 (POLB), E.078808 (SDF4), E.083720 (OXCT1), E.100084 (HIRA), E.101246 (ARFRP1), E.102241 (HTATSF1), E.103591 (AGAB), E.104626 (ERI1), E.105221 (AKT2), E.105402 (NAPA), E.105705 (SUGP1), E.106346 (USP42), E.108639 (SYNGR2), E.110107 (PRPF19), E.112473 (SLC39A7), E.113282 (CLINT1), E.115234 (SNX17), E.115561 (CHMP3), E.119906 (FAM178A), E.120733 (KDM3B), E.125375 (ATP5S), E.125798 (FOXA2), E.127415 (IDUA), E.129810 (SGOL1), E.132382 (MYBBP1A), E.133313 (CNDP2), E.134077 (THUMPD3), E.134248 (HBXIP), E.135597 (REPS1), E.137814 (HAUS2), E.138041 (SMEK2), E.140382 (HMG20A), E.143578 (CREB3L4), E.144224 (UBXN4), E.144306 (SCRN3), E.144741 (SLC25A26), E.145919 (BOD1), E.146281 (PM20D2), E.152359 (POC5), E.152409 (JMY), E.154889 (MPPE1), E.157551 (KCNJ15), E.157764 (BRAF), E.158987 (RAPGEF6), E.162069 (CCDC64B), E.162910 (MRPL55), E.163749 (CCDC158), E.164045 (CDC25A), E.164300 (SERINC5), E.165898 (ISCA2), E.167987 (VPS37C), E.168763 (CNNM3), E.170374 (SP7), E.171488 (LRRC8C), E.178381 (ZFAND2A), E.180998 (GPR137C), E.182318 (ZSCAN22), E.198040 (ZNF84), E.198216 (CACNA1E), E.198265 (HELZ), E.198586 (TLK1), E.203795 (FAM24A), E.204231 (RXRB), E.123992 (DNPEP), E.184634 (MED12), E.181885 (CLDN7), E.186660 (ZFP91), E.126777 (KTN1), E.080823 (MOK), E.101811 (CSTF2), E.124570 (SERPINB6), E.148835 (TAF5), E.158715 (SLC45A3), E.110955 (ATP5B), E.127602 (CANX), E.142208 (AKT1), E.128881 (TTBK2), E.147231 (CXorf57), E.006210 (CX3CL1), E.009830 (POMT2), E.011114 (BTBD7), E.065057 (NTHL1), E.068724 (TTC7A), E.073584 (SMARCE1), E.079785 (DDX1), E.084463 (WBP11), E.091140 (DLD), E.099821 (POLRMT), E.101126 (ADNP), E.104442 (ARMC1), E.105486 (LIG1), E.110921 (MVK), E.113441 (LNPEP), E.115758 (ODC1), E.116726 (PRAMEF12), E.119681 (LTBP2), E.136933 (RABEPK), E.137815 (RTF1), E.138095 (LRPPRC), E.138294 (MSMB), E.141873 (SLC39A3), E.142698 (C1orf94), E.143390 (RFX5), E.148488 (ST8SIA6), E.148737 (TCF7L2), E.151491 (EPS8), E.152422 (XRCC4), E.154832 (CXXC1), E.158321 (AUTS2), E.159147 (DONSON), E.160285 (LSS), E.160862 (AZGP1), E.160948 (VPS28), E.160972 (PPP1R16A), E.165934 (CPSF2), E.167604 (NFKBID), E.167766 (ZNF83), E.168803 (ADAL), E.169612 (FAM103A1), E.171262 (FAM98B), E.172893 (DHCR7), E.173889 (PHC3), E.176971 (FIBIN), E.177548 (RABEP2), E.179119 (SPTY2D1), E.184378 (ACTRT3), E.184508 (HDDC3), E.185043 (CIB1), E.186814 (ZSCAN30), E.186868 (MAPT), E.196812 (ZSCAN16), E.198563 (DDX39B), E.124529 (HIST1H4B), E.141002 (TCF25), E.174100 (MRPL45), E.109814 (UGDH), E.138756 (BMP2K), E.065457 (ADAT1), E.105948 (TTC26), E.109184 (DCUN1D4), E.125257 (ABCC4), E.126062 (TMEM115), E.142515 (KLK3), E.144381 (HSPD1), E.166710 (B2M), E.198824 (CHAMP1), E.078902 (TOLLIP), E.099331 (MYO9B), E.102710 (FAM48A), E.107485 (GATA3), E.120948 (TARDBP), E.187764 (SEMA4D), E.103855 (CD276), E.117751 (PPP1R8), E.173714 (WFIKKN2), E.172115 (CYCS), E.005882 (PDK2), E.007952 (NOX1), E.008118 (CAMK1G), E.012061 (ERCC1), E.015171 (ZMYND11), E.036257 (CUL3), E.057608 (GDI2), E.058729 (RIOK2), E.071246 (VASH1), E.073050 (XRCC1), E.073350 (LLGL2), E.079246 (XRCC5), E.085733 (CTTN), E.091542 (ALKBH5), E.091732 (ZC3HC1), E.092621 (PHGDH), E.099899 (TRMT2A), E.099917 (MED15), E.101439 (CST3), E.103479 (RBL2), E.104611 (SH2D4A), E.105281 (SLC1A5), E.106392 (C1GALT1), E.107104 (KANK1), E.107798 (LIPA), E.108296 (CWC25), E.109572 |

TABLE 4-continued

Illustrative Biomarkers

| Illustrative Class | Biomarkers |
|---|---|
| | (CLCN3), E.112110 (MRPL18), E.113790 (EHHADH), E.115648 (MLPH), E.117308 (GALE), E.117335 (CD46), E.118513 (MYB), E.118640 (VAMP8), E.119321 (FKBP15), E.122705 (CLTA), E.123983 (ACSL3), E.124232 (RBPJL), E.125901 (MRPS26), E.127399 (LRRC61), E.127554 (GFER), E.128708 (HAT1), E.129355 (CDKN2D), E.130340 (SNX9), E.130935 (NOL11), E.131771 (PPP1R1B), E.133863 (TEX15), E.134207 (SYT6), E.136935 (GOLGA1), E.141425 (RPRD1A), E.143374 (TARS2), E.143771 (CNIH4), E.146966 (DENND2A), E.148672 (GLUD1), E.150593 (PDCD4), E.153936 (HS2ST1), E.154099 (DNAAF1), E.156006 (NAT2), E.156282 (CLDN17), E.158545 (ZC3H18), E.158604 (TMED4), E.158813 (EDA), E.159184 (HOXB13), E.161267 (BDH1), E.163492 (CCDC141), E.163629 (PTPN13), E.164163 (ABCE1), E.164520 (RAET1E), E.165138 (ANKS6), E.165923 (AGBL2), E.166484 (MAPK7), E.166747 (AP1G1), E.166971 (AKTIP), E.167744 (NTF4), E.168071 (CCDC88B), E.169087 (HSPBAP1), E.170396 (ZNF804A), E.170445 (HARS), E.170632 (ARMC10), E.170743 (SYT9), E.171428 (NAT1), E.172346 (CSDC2), E.173805 (HAP1), E.175175 (PPM1E), E.175203 (DCTN2), E.177542 (SLC25A22), E.177679 (SRRM3), E.178828 (RNF186), E.182013 (PNMAL1), E.182054 (IDH2), E.182890 (GLUD2), E.184156 (KCNQ3), E.184697 (CLDN6), E.184735 (DDX53), E.184840 (TMED9), E.185219 (ZNF445), E.186198 (SLC51B), E.186205 (MOSC1; MARC1), E.189 143 (CLDN4), E.196700 (ZNF512B), E.196743 (GM2A), E.198087 (CD2AP), E.198951 (NAGA), E.204406 (MBD5), E.002330 (BAD), E.105404 (RABAC1), E.114127 (XRN1), E.117713 (ARID1A), E.123143 (PKN1), E.130764 (LRRC47), E.131773 (KHDRBS3), E.137806 (NDUFAF1), E.142864 (SERBP1), E.158747 (NBL1), E.175063 (UBE2C), E.178104 (PDE4DIP), E.186472 (PCLO), E.069956 (MAPK6), E.112941 (PAPD7), E.116604 (MEF2D), E.142875 (PRKACB), E.147133 (TAF1), E.157510 (AFAP1L1), E.006625 (GGCT), E.155980 (KIF5A), E.134444 (KIAA1468), E.107968 (MAP3K8), E.117592 (PRDX6), E.123154 (WDR83), E.135297 (MTO1), E.135829 (DHX9), E.149548 (CCDC15), E.152086 (TUBA3E), E.167553 (TUBA1C), E.169826 (CSGALNACT2), E.171121 (KCNMB3), E.198033 (TUBA3C), E.147724 (FAM135B), E.170854 (MINA), E.006695 (COX10), E.067369 (TP53BP1), E.089248 (ERP29), E.112096 (SOD2), E.138073 (PREB), E.146856 (AGBL3), E.159423 (ALDH4A1), E.171345 (KRT19), E.172345 (STARD5), E.111647 (UHRF1BP1L), E.117877 (CD3EAP), E.155714 (PDZD9), E.156603 (MED19), E.075886 (TUBA3D), E.167699 (GLOD4), E.121749 (TBC1D15), E.090861 (AARS), E.093010 (COMT), E.117676 (RPS6KA1), E.157502 (MUM1L1), E.159921 (GNE), E.169562 (GJB1), E.179776 (CDH5), E.071626 (DAZAP1), E.085224 (ATRX), E.116478 (HDAC1), E.117298 (ECE1), E.176171 (BNIP3), E.177425 (PAWR), E.179348 (GATA2), E.187840 (EIF4EBP1), E.033030 (ZCCHC8), E.049239 (H6PD), E.060688 (SNRNP40), E.075239 (ACAT1), E.095627 (TDRD1), E.109625 (CPZ), E.113719 (ERGIC1), E.126773 (C14orf135; PCNXL4), E.149218 (ENDOD1), E.162975 (KCNF1), E.183785 (TUBA8), E.198589 (LRBA), E.105379 (ETFB), E.011052 (NME2), E.011143 (MKS1), E.048544 (MRPS10), E.062485 (CS), E.114054 (PCCB), E.138587 (MNS1), E.155959 (VBP1), E.181222 (POLR2A), E.183723 (CMTM4), E.184661 (CDCA2), E.204316 (MRPL38), E.140694 (PARN), E.035141 (FAM136A), E.095485 (CWF19L1), E.115540 (MOB4), E.123595 (RAB9A), E.140678 (ITGAX), E.141258 (SGSM2), E.158941 (KIAA1967), E.169189 (NSMCE1), E.198431 (TXNRD1), E.016402 (IL20RA), E.112234 (FBXL4), E.125445 (MRPS7), E.128342 (LIF), E.164051 (CCDC51), E.175866 (BAIAP2), E.102780 (DGKH), E.203813 (HIST1H3H), E.198231 (DDX42), E.030582 (GRN), E.106049 (HIBADH), E.130810 (PPAN), E.132475 (H3F3B), E.158290 (CUL4B), E.166266 (CUL5), E.026559 (KCNG1), E.059122 (FLYWCH1), E.107897 (ACBD5), E.121068 (TBX2), E.125944 (HNRNPR), E.134308 (YWHAQ), E.137558 (PI15), E.137601 (NEK1), E.147548 (WHSC1L1), E.149182 (ARFGAP2), E.159658 (KIAA0494), E.165699 (TSC1), E.170927 (PKHD1), E.186575 (NF2), E.188021 (UBQLN2), E.167552 (TUBA1A), E.003756 (RBM5), E.134138 (MEIS2), E.008196 (TFAP2B), E.079313 (REXO1), E.089127 (OAS1), E.106078 (COBL), E.113645 (WWC1), E.116288 (PARK7), E.121940 (CLCC1), E.136280 (CCM2), E.141639 (MAPK4), E.147475 (ERLIN2), E.155660 (PDIA4), E.162298 (SYVN1), E.176978 (DPP7), E.176994 (SMCR8), E.178175 (ZNF366), E.196591 (HDAC2), E.127824 (TUBA4A), E.163932 (PRKCD), E.143375 (CGN), E.076864 (RAP1GAP), E.138772 (ANXA3), E.163041 (H3F3A), E.165813 (C10orf18), E.166337 (TAF10), E.178078 (STAP2), E.184007 (PTP4A2), E.167004 (PDIA3), E.039560 (RAI14), E.119636 (C14orf45), E.140374 (ETFA), E.143633 (C1orf131), E.144935 (TRPC1), E.156735 (BAG4), E.159348 (CYB5R1), E.170275 (CRTAP), E.172717 (FAM71D), E.172939 (OXSR1), E.176105 (YES1), E.078295 (ADCY2), E.119888 (EPCAM), E.141522 (ARHGDIA), E.184047 (DIABLO), E.109062 (SLC9A3R1), E.170037 (CNTROB), E.066557 (LRRC40), E.074964 (ARHGEF10L), E.078269 (SYNJ2), E.090013 (BLVRB), E.100142 (POLR2F), E.100399 (CHADL), E.104365 (IKBKB), E.111261 (MANSC1), E.111907 (TPD52L1), E.112578 (BYSL), E.121957 (GPSM2), E.122884 (P4HA1), E.124693 (HIST1H3B), E.126653 (NSRP1), E.130402 (ACTN4), E.138757 (G3BP2), E.150991 (UBC), E.164828 (SUN1), E.175216 (CKAP5), E.176155 (CCDC57), E.177459 (C8orf47), E.183856 (IQGAP3), E.185122 (HSF1), E.122952 (ZWINT), E.151093 (OXSM), E.067704 (IARS2), E.088899 (ProSAP-interacting protein 1), E.091483 (FH), E.114388 (NPRL2), E.114861 (FOXP1), E.135914 (HTR2B), E.197837 (HIST4H4), E.127720 (C12orf26; METTL25), E.123416 (TUBA1B), E.047410 (TPR), E.117748 (RPA2), E.133835 (HSD17B4), E.067248 (DHX29), E.121879 (PIK3CA), E.132589 (FLOT2), E.136750 (GAD2), E.160789 (LMNA), E.166329, E.170088 (TMEM192), E.175946 (KLHL38), E.178163 (ZNF518B), E.182217 (HIST2H4B), E.184470 (TXNRD2), E.110321 (EIF4G2), E.171861 (RNMTL1), E.065978 (YBX1), E.115738 (ID2), E.143294 (PRCC), E.158042 (MRPL17), E.169093 (ASMTL), E.090565 (RAB11FIP3), E.185591 (SP1), E.156304 (SCAF4), E.092978 (GPATCH2), E.100056 |

TABLE 4-continued

Illustrative Biomarkers

| Illustrative Class | Biomarkers |
|---|---|
| | (DGCR14), E.100583 (SAMD15), E.105723 (GSK3A), E.107551 (RASSF4), E.107581 (EIF3A), E.107890 (ANKRD26), E.110104 (CCDC86), E.112584 (FAM120B), E.113580 (NR3C1), E.114491 (UMPS), E.137312 (FLOT1), E.137955 (RABGGTB), E.141994 (DUS3L), E.147044 (CASK), E.152818 (UTRN), E.180667 (YOD1), E.184916 (JAG2), E.196526 (AFAP1), E.198783 (ZNF830), E.108465 (CDK5RAP3), E.156515 (HK1), E.036448 (MYOM2), E.061918 (GUCY1B3), E.070785 (EIF2B3), E.116044 (NFE2L2), E.128311 (TST), E.131473 (ACLY), E.132716 (DCAF8), E.138363 (ATIC), E.166596 (WDR16), E.170027 (YWHAG), E.174021 (GNG5), E.203879 (GDI1), E.160049 (DFFA), E.010810 (FYN), E.051596 (THOC3), E.006453 (BAI1-associated protein 2-like 1), E.126945 (HNRNPH2), E.165695 (AK8), E.069869 (NEDD4), E.111801 (BTN3A3), E.112232 (KHDRBS2), E.128626 (MRPS12), E.129636 (ITFG1), E.137948 (BRDT), E.147257 (GPC3), E.155380 (SLC16A1), E.159692 (CTBP1), E.166833 (NAV2), E.172466 (ZNF24), E.175110 (MRPS22), E.176102 (CSTF3), E.179388 (EGR3), E.185359 (HGS), E.198001 (IRAK4), E.100603 (SNW1), E.162641 (AKNAD1), E.069712 (KIAA1107), E.073756 (PTGS2), E.077522 (ACTN2), E.101639 (CEP192), E.106633 (GCK), E.115241 (PPM1G), E.116649 (SRM), E.120370 (GORAB), E.124143 (ARHGAP40), E.127948 (POR), E.129315 (CCNT1), E.132646 (PCNA), E.135740 (SLC9A5), E.151726 (ACSL1), E.154380 (ENAH), E.157103 (SLC6A1), E.163930 (BAP1), E.164488 (DACT2), E.164754 (RAD21), E.175220 (ARHGAP1), E.180318 (ALX1), E.181234 (TMEM132C), E.197081 (IGF2R), E.092871 (RFFL), E.163644 (PPM1K), E.171723 (GPHN), E.108953 (YWHAE), E.072110 (ACTN1), E.077097 (TOP2B), E.090889 (KIF4A), E.114331 (ACAP2), E.114867 (EIF4G1), E.117593 (DARS2), E.118523 (CTGF), E.120915 (EPHX2), E.134759 (ELP2), E.138061 (CYP1B1), E.140743 (CDR2), E.151247 (EIF4E), E.152942 (RAD17), E.160685 (ZBTB7B), E.163923 (RPL39L), E.167642 (SPINT2), E.167996 (FTH1), E.185736 (ADARB2), E.198841 (KTI12), E.185860 (C1orf110), E.160226 (C21orf2), E.070814 (TCOF1), E.124749 (COL21A1), E.154639 (CXADR), E.065485 (PDIA5), E.023909 (GCLM), E.100714 (MTHFD1), E.108387 (SEPT4), E.160867 (FGFR4), E.134684 (YARS), E.123080 (CDKN2C), E.065548 (ZC3H15), E.116455 (WDR77), E.117448 (AKR1A1), E.100393 (EP300), E.138160 (KIF11), E.166263 (STXBP4), E.173473 (SMARCC1), E.124942 (AHNAK), E.174842 (GLMN), E.180198 (RCC1), E.185499 (MUC1), E.143947 (RPS27A), E.170315 (UBB), E.003402 (CFLAR), E.137055 (PLAA), E.142606 (MMEL1), E.147697 (GSDMC), E.163110 (PDLIM5), E.135842 (FAM129A), E.160691 (SHC1), E.197157 (SND1), E.029725 (RABEP1), E.127946 (HIP1), E.001036 (FUCA2), E.109846 (CRYAB), E.183831 (ANKRD45), E.189283 (FHIT), E.092820 (EZR), E.104067 (TJP1), E.120159 (C9orf82; CAAP1), E.154864 (PIEZO2), E.196975 (ANXA4), E.105220 (GPI), E.127914 (AKAP9), E.135870 (RC3H1), E.026508 (CD44), E.089154 (GCN1L1), E.100311 (PDGFB), E.119383 (PPP2R4), E.075624 (ACTB), E.177409 (SAMD9L), E.177731 (FLII), E.015676 (NUDCD3), E.146457 (WTAP), E.178950 (GAK), E.167110 (GOLGA2) |
| Prostate vesicle | LAMP2, ACPP, CTNNA1, HEBP2, ISOC2, HNRNPC, HNRNPM, TOMM22, TOM1, ACO2, KRT18, HSPA9, LMNB1, SPR, PPL, ALDH6A1, HNRNPA2B1, ATXN1, SMARCA4, ECHS1, PAICS, ILF3, PSME3, COX5B, RAB1A, SCARB2, HADH, ESD, SORD, ILF2, CALM2, ATP5A1, TGOLN2, ANGPTL4, ALCAM, KRT2, PC, NPM1, C1orf116, GPC6, ALDH1A3, HIST1H1C, XRCC6, HNRNPAB, PSAP, CDH1, SCAMP2, VASP, CD9, ATP1B3, HSD17B10, APAF1, EIF2C2, RAB5A, CFL2, FARSA, XPNPEP3, ENTPD4, APLP2, NUCB1, RAB3D, VEGFA, HPS3, TSNAXIP1, HNRNPL, PSMB7, GNA12, NONO, FOLH1, PRKAR2A, PHB, HIST3H3, MAP7, VCP, U2AF2, FUS, FKBP5, NDRG1, ATP1A3, NCL, RPL36, KRT8, C1GALT1C1, FASN, PTBP1, TXNDC16, DNAJC5, SLC37A2, HNRNPK, VDAC2, PRDX2, TALDO1, USP14, PSMD7, HSPE1, DNAJB1, YWHAZ, RAB3B, CORO1B, MDH2, HIST1H3A, LAMP1, STC2, DSTN, SLC20A2, ENPP4, WIZ, HSP90AB1, IDH3B, ECH1, C1QBP, SET, TNFSF18, ITGB7, SPOCK1, EIF4A2, CCT3, CLDN3, EEF2, LRRC57, RUVBL2, CLDN5, APPL2, TM9SF2, EIF4A3, DBI, DBF4B, SVIP, CD151, ALOX5, SLC9A3R2, RAB27B, DLG1, ARCN1, CHCHD3, RAB5B, RPS25, RPL10, DDAH1, HSP90B1, CTNNB1, PSMD2, PKP3, FLNB, EFTUD2, GLO1, PRKCSH, TMBIM1, SEC31A, TMED10, RPL14, MATR3, APEX1, B4GALT1, HNRNPA1, CPD, HSPA1A, CAPN1, CHRDL2, SPEN, SDF4, NAPA, SYNGR2, CHMP3, CNDP2, CCDC64B, SERINC5, VPS37C, DNPEP, CLDN7, KTN1, SERPINB6, ATP5B, CANX, AKT1, TTBK2, DDX1, DLD, LNPEP, LTBP2, LRPPRC, EPS8, AZGP1, VPS28, DHCR7, CIB1, DDX39B, HIST1H4B, UGDH, HSPD1, B2M, TOLLIP, CD276, CYCS, CUL3, GDI2, LLGL2, XRCC5, CTTN, PHGDH, CST3, RBL2, SLC1A5, CD46, VAMP8, CLTA, ACSL3, MRPS26, SNX9, GLUD1, TMED4, PTPN13, AP1G1, SYT9, DCTN2, IDH2, GLUD2, TMED9, CLDN4, GM2A, CD2AP, MBD5, SERBP1, NBL1, PRKACB, GGCT, PRDX6, DHX9, TUBA3E, TUBA1C, TUBA3C, ERP29, SOD2, KRT19, TUBA3D, AARS, COMT, MUM1L1, CDH5, ECE1, ACAT1, ENDOD1, TUBA8, ETFB, NME2, CS, VBP1, RAB9A, TXNRD1, LIF, BAIAP2, HIST1H3H, GRN, HIBADH, H3F3B, CUL4B, HNRNPR, YWHAQ, PKHD1, TUBA1A, PARK7, ERLIN2, PDIA4, TUBA4A, PRKCD, ANXA3, H3F3A, PTP4A2, PDIA3, ETFA, CYB5R1, CRTAP, OXSR1, YES1, EPCAM, ARHGDIA, DIABLO, SLC9A3R1, BLVRB, P4HA1, HIST1H3B, ACTN4, UBC, FH, HIST4H4, TUBA1B, HSD17B4, PIK3CA, FLOT2, LMNA, TMEM192, HIST2H4B, YBX1, EIF3A, FLOT1, UTRN, HK1, ACLY, ATIC, YWHAG, GNG5, GDI1, HNRNPH2, NEDD4, BTN3A3, SLC16A1, HGS, ACTN2, SRM, PCNA, ACSL1, RAD21, ARHGAP1, IGF2R, YWHAE, ACTN1, EIF4G1, EPHX2, EIF4E, FTH1, CXADR, MTHFD1, AKR1A1, STXBP4, AHNAK, MUC1, RPS27A, UBB, PDLIM5, FAM129A, SND1, FUCA2, CRYAB, EZR, TJP1, ANXA4, GPI, AKAP9, CD44, GCN1L1, ACTB, FLII, NUDCD3 |
| Prostate Cancer vesicles | EGFR, GLUD2, ANXA3, APLP2, BclG, Coiflin 2/cfL2, DCTN-50/DCTN2, DDAH1, ESD, FARSLA, GITRL, PRKCSH, SLC20A2, Synaptogyrin 2/SYNGR2, TM9SF2, |

TABLE 4-continued

Illustrative Biomarkers

| Illustrative Class | Biomarkers |
|---|---|
| | Calnexin, TOMM22, NDRG1, RPL10, RPL14, USP14, VDAC2, LLGL2, CD63, CD81, uPAR/CD87, ADAM 9, BDKRB2, CCR5, CCT2 (TCP1-beta), PSMA, PSMA1, HSPB1, VAMP8, Rab1A, B4GALT1, Aspartyl Aminopeptidase/Dnpep, ATPase Na+/K+ beta 3/ATP1B3, BDNF, ATPB, beta 2 Microglobulin, Calmodulin 2/CALM2, CD9, XRCC5/Ku80, SMARCA4, TOM1, Cytochrome C, Hsp10/HSPE1, COX2/PTGS2, Claudin 4/CLDN4, Cytokeratin 8, Cortactin/CTTN, DBF4B/DRF1, ECH1, ECHS1, GOLPH2, ETS1, DIP13B/appl2, EZH2/KMT6, GSTP1, hK2/Kif2a, IQGAP1, KLK13, Lamp-2, GM2A, Hsp40/DNAJB1, HADH/HADHSC, Hsp90B, Nucleophosmin, p130/RBL2, PHGDH, RAB3B, ANXA1, PSMD7, PTBP1, Rab5a, SCARB2, Stanniocalcin 2/STC2, TGN46/TGOLN2, TSNAXIP1, ANXA2, CD46, KLK14, IL1alpha, hnRNP C1 + C2, hnRNP A1, hnRNP A2B1, Claudin 5, CORO1B, Integrin beta 7, CD41, CD49d, CDH2, COX5b, IDH2, ME1, PhIP, ALDOA, EDNRB/EDN3, MTA1, NKX3-1, TMPRSS2, CD10, CD24, CDH1, ADAM10, B7H3, CD276, CHRDL2, SPOCK1, VEGFA, BCHE, CD151, CD166/ALCAM, CSE1L, GPC6, CXCR3, GAL3, GDF15, IGFBP-2, HGF, KLK12, ITGAL, KLK7, KLK9, MMP 2, MMP 25, MMP10, TNFR1, Notch 1, PAP - same as ACPP, PTPN13/PTPL1, seprase/FAP, TNFRI, TWEAK, VEGFR2, E-Cadherin, Hsp60, CLDN3—Claudin3, KLK6, KLK8, EDIL3 (del-1), APE1, MMP 1, MMP3, nAnS, PSP94/MSP/IGBF, PSAP, RPL19, SET, TGFB, TGM2, TIMP-1, TNFRII, MDH2, PKP1, Cystatin C, Trop2/TACSTD2, CCR2/CD192, hnRNP M1-M4, CDKN1A, CGA, Cytokeratin 18, EpoR, GGPS1, FTL (light and heavy), GM-CSF, HSP90AA1, IDH3B, MKI67/Ki67, LTBP2, KLK1, KLK4, KLK5, LDH-A, Nav1.7/SCN9A, NRP1/CD304, PIP3/BPNT1, PKP3, CgA, PRDX2, SRVN, ATPase Na+/K+ alpha 3/ATP1A3, SLC3A2/CD98, U2AF2, TLR4 (CD284), TMPRSS1, TNFα, uPA, GloI, ALIX, PKM2, FABP5, CAV1, TLR9/CD289, ANXA4, PLEKHC1/Kindlin-2, CD71/TRFR, MBD5, SPEN/RBM15, LGALS8, SLC9A3R2, ENTPD4, ANGPTL4, p97/VCP, TBX5, PTEN, Prohibitin, LSP1, HOXB13, DDX1, AKT1, ARF6, EZR, H3F3A, CIB1, Ku70 (XRCC6), KLK11, TMBIM6, SYT9, APAF1, CLDN7, MATR3, CD90/THY1, Tollip, NOTCH4, 14-3-3 zeta/beta, ATP5A1, DLG1, GRP94, FKBP5/FKBP51, LAMP1, LGALS3BP, GDI2, HSPA1A, NCL, KLK15, Cytokeratin basic, EDN-3, AGR2, KLK10, BRG1, FUS, Histone H4, hnRNP L, Catenin Alpha 1, hnRNP K (F45)*, MMP7*, DBI*, beta catenin, CTH, CTNND2, Ataxin 1, Proteasome 20S beta 7, ADE2, EZH2, GSTP1, Lamin B1, Coatomer Subunit Delta, ERAB, Mortalin, PKM2, IGFBP-3, CTNND1/delta 1-catenin/p120-catenin, PKA R2, NONO, Sorbitol Dehydrogenase, Aconitase 2, VASP, Lipoamide Dehydrogenase, AP1G1, GOLPH2, ALDH6A1, AZGP1, Ago2, CNDP2, Nucleobindin-1, SerpinB6, RUVBL2, Proteasome 19S 10B, SH3PX1, SPR, Destrin, MDM4, FLNB, FASN, PSME |
| Prostate Cancer vesicles | 14-3-3 zeta/beta, Aconitase 2, ADAM 9, ADAM10, ADE2, AFM, Ago2, AGR2, AKT1, ALDH1A3, ALDH6A1, ALDOA, ALIX, ANGPTL4, ANXA1, ANXA2, ANXA3, ANXA3, ANXA4, AP1G1, APAF1, APE1, APLP2, APLP2, ARF6, Aspartyl Aminopeptidase/Dnpep, Ataxin 1, ATP5A1, ATPase Na+/K+ alpha 3/ATP1A3, ATPase Na+/K+ beta 3/ATP1B3, ATPase Na+/K+ beta 3/ATP1B3, ATPB, AZGP1, B4GALT1, B7H3, BCHE, BclG, BDKRB2, BDNF, BDNF, beta 2 Microglobulin, beta catenin, BRG1, CALM2, Calmodulin 2/CALM2, Calnexin, Calpain 1, Catenin Alpha 1, CAV1, CCR2/CD192, CCR5, CCT2 (TCP1-beta), CD10, CD151, CD166/ALCAM, CD24, CD276, CD41, CD46, CD49d, CD63, CD71/TRFR, CD81, CD9, CD9, CD90/THY1, CDH1, CDH2, CDKN1A, CGA, CgA, CHRDL2, CIB1, CIB1, Claudin 4/CLDN4, Claudin 5, CLDN3, CLDN3—Claudin3, CLDN4, CLDN7, CNDP2, Coatomer Subunit Delta, Cofilin 2/cfL2, CORO1B, Cortactin/CTTN, COX2/PTGS2, COX5b, CSE1L, CTH, CTNND1/delta 1-catenin/p120-catenin, CTNND2, CXCR3, CYCS, Cystatin C, Cytochrome C, Cytokeratin 18, Cytokeratin 8, Cytokeratin basic, DBF4B/DRF1, DBI*, DCTN-50/DCTN2, DDAH1, DDAH1, DDX1, Destrin, DIP13B/appl2, DIP13B/appl2, DLG1, Dnpep, E-Cadherin, ECH1, ECHS1, ECHS1, EDIL3 (del-1), EDN-3, EDNRB/EDN3, EGFR, EIF4A3, ENTPD4, EpoR, EpoR, ERAB, ESD, ESD, ETS1, ETS1, ETS-2, EZH2, EZH2/KMT6, EZR, FABP5, FARSLA, FASN, FKBP5/FKBP51, FLNB, FTL (light and heavy), FUS, GAL3, gamma-catenin, GDI2, GGPS1, GGPS1, GITRL, GloI, GLUD2, GM2A, GM-CSF, GOLM1/GOLPH2 Mab; clone 3B10, GOLPH2, GOLPH2, GPC6, GRP94, GSTP1, GSTP1, H3F3A, HADH/HADHSC, HGF, HIST1H3A, Histone H4, hK2/Kif2a, hnRNP A1, hnRNP A2B1, hnRNP C1 + C2, hnRNP K (F45)*, hnRNP L, hnRNP M1-M4, HOXB13, Hsp10/HSPE1, Hsp40/DNAJB1, Hsp60, HSP90AA1, Hsp90B, HSPA1A, HSPB1, IDH2, IDH3B, IDH3B, IGFBP-2, IGFBP-3, IgG1, IgG2A, IgG2B, IL1alpha, IL1alpha, Integrin beta 7, IQGAP1, ITGAL, KLHL12/C3IP1, KLK1, KLK10, KLK11, KLK12, KLK13, KLK14, KLK15, KLK4, KLK5, KLK6, KLK7, KLK8, KLK9, Ku70 (XRCC6), Lamin B1, LAMP1, Lamp-2, LDH-A, LGALS3BP, LGALS8, Lipoamide Dehydrogenase, LLGL2, LSP1, LSP1, LTBP2, MATR3, MBD5, MDH2, MDM4, ME1, MKI67/Ki67, MMP 1, MMP 2, MMP 25, MMP10, MMP-14/MT1-MMP, MMP3, MMP7*, Mortalin, MTA1, nAnS, nAnS, Nav1.7/SCN9A, NCL, NDRG1, NKX3-1, NONO, Notch1, NOTCH4, NRP1/CD304, Nucleobindin-1, Nucleophosmin, p130/RBL2, p97/VCP, PAP - same as ACPP, PHGDH, PhIP, PIP3/BPNT1, PKA R2, PKM2, PKM2, PKP1, PKP3, PLEKHC1/Kindlin-2, PRDX2, PRKCSH, Prohibitin, Proteasome 19S 10B, Proteasome 20S beta 7, PSAP, PSMA, PSMA1, PSMA1, PSMD7, PSMD7, PSME3, PSP94/MSP/IGBF, PTBP1, PTEN, PTPN13/PTPL1, Rab1A, RAB3B, Rab5a, Rad51b, RPL10, RPL10, RPL14, RPL14, RPL19, RUVBL2, SCARB2, seprase/FAP, SerpinB6, SET, SH3PX1, SLC20A2, SLC3A2/CD98, SLC9A3R2, SMARCA4, Sorbitol Dehydrogenase, SPEN/RBM15, SPOCK1, SPR, SRVN, Stanniocalcin 2/STC2, STEAP1, Synaptogyrin 2/SYNGR2, Syndecan, SYNGR2, SYT9, TAF1B/GRHL1, TBX5, TGFB, TGM2, TGN46/TGOLN2, TIMP-1, TLR3, TLR4 (CD284), TLR9/CD289, TM9SF2, TMBIM6, TMPRSS1, TMPRSS2, TNFR1, TNFRI, TNFRII, TNFSF18/GITRL, TNFα, TNFα, Tollip, TOM1, TOMM22, Trop2/TACSTD2, TSNAXIP1, TWEAK, |

TABLE 4-continued

Illustrative Biomarkers

| Illustrative Class | Biomarkers |
|---|---|
| | U2AF2, uPA, uPAR/CD87, USP14, USP14, VAMP8, VASP, VDAC2, VEGFA, VEGFR1/FLT1, VEGFR2, VPS28, XRCC5/Ku80, XRCC5/Ku80 |
| Prostate Vesicles/ General Vesicles | EpCAM/TROP-1, HSA, Fibrinogen, GAPDH, Cholesterol Oxidase, MMP7, Complement Factor D/Adipsin, E-Cadherin, Transferrin Antibody, eNOS, IgM, CD9, Apolipoprotein B (Apo B), Ep-CAM, TBG, Kallekerin 3, IgA, IgG, Annexin V, IgG, Pyruvate Carboxylase, trypsin, AFP, TNF RI/TNFRSF1A, Aptamer CAR023, Aptamer CAR024, Aptamer CAR025, Aptamer CAR026 |
| Ribonucleoprotein complexes & vesicles | GW182, Ago2, miR-let-7a, miR-16, miR-22, miR-148a, miR-451, miR-92a, CD9, CD63, CD81 |
| Prostate Cancer vesicles | PCSA, Muc2, Adam10 |
| Prostate Cancer vesicles | Alkaline Phosphatase (AP), CD63, MyoD1, Neuron Specific Enolase, MAP1B, CNPase, Prohibitin, CD45RO, Heat Shock Protein 27, Collagen II, Laminin B1/b1, Gai1, CDw75, bcl-XL, Laminin-s, Ferritin, CD21, ADP-ribosylation Factor (ARF-6) |
| Prostate Cancer vesicles | CD56/NCAM-1, Heat Shock Protein 27/hsp27, CD45RO, MAP1B, MyoD1, CD45/T200/LCA, CD3zeta, Laminin-s, bcl-XL, Rad18, Gai1, Thymidylate Synthase, Alkaline Phosphatase (AP), CD63, MMP-16/MT3-MMP, Cyclin C, Neuron Specific Enolase, SIRP a1, Laminin B1/b1, Amyloid Beta (APP), SODD (Silencer of Death Domain), CDC37, Gab-1, E2F-2, CD6, Mast Cell Chymase, Gamma Glutamylcysteine Synthetase (GCS) |
| Prostate Cancer vesicles | EpCAM, MMP7, PCSA, BCNP, ADAM10, KLK2, SPDEF, CD81, MFGE8, IL-8 |
| Prostate Cancer vesicles | EpCAM, KLK2, PBP, SPDEF, SSX2, SSX4 |
| Prostate Cancer vesicles | ADAM-10, BCNP, CD9, EGFR, EpCam, IL1B, KLK2, MMP7, p53, PBP, PCSA, SERPINB3, SPDEF, SSX2, SSX4 |
| Androgen Receptor (AR) pathway members in cMVs | GTF2F1, CTNNB1, PTEN, APPL1, GAPDH, CDC37, PNRC1, AES, UXT, RAN, PA2G4, JUN, BAG1, UBE2I, HDAC1, COX5B, NCOR2, STUB1, HIPK3, PXN, NCOA4 |
| EGFR1 pathway members in cMVs | RALBP1, SH3BGRL, RBBP7, REPS1, SNRPD2, CEBPB, APPL1, MAP3K3, EEF1A1, GRB2, RAC1, SNCA, MAP2K3, CEBPA, CDC42, SH3KBP1, CBL, PTPN6, YWHAB, FOXO1, JAK1, KRT8, RALGDS, SMAD2, VAV1, NDUFA13, PRKCB1, MYC, JUN, RFXANK, HDAC1, HIST3H3, PEBP1, PXN, TNIP1, PKN2 |
| TNF-alpha pathway members in cMVs | BCL3, SMARCE1, RPS11, CDC37, RPL6, RPL8, PAPOLA, PSMC1, CASP3, AKT2, MAP3K7IP2, POLR2L, TRADD, SMARCA4, HIST3H3, GNB2L1, PSMD1, PEBP1, HSPB1, TNIP1, RPS13, ZFAND5, YWHAQ, COMMD1, COPS3, POLR1D, SMARCC2, MAP3K3, BIRC3, UBE2D2, HDAC2, CASP8, MCM7, PSMD7, YWHAG, NFKBIA, CAST, YWHAB, G3BP2, PSMD13, FBL, RELB, YWHAZ, SKP1, UBE2D3, PDCD2, HSP90AA1, HDAC1, KPNA2, RPL30, GTF2I, PFDN2 |
| Colorectal cancer | CD9, EGFR, NGAL, CD81, STEAP, CD24, A33, CD66E, EPHA2, Ferritin, GPR30, GPR110, MMP9, OPN, p53, TMEM211, TROP2, TGM2, TIMP, EGFR, DR3, UNC93A, MUC17, EpCAM, MUC1, MUC2, TSG101, CD63, B7H3 |
| Colorectal cancer | DR3, STEAP, epha2, TMEM211, unc93A, A33, CD24, NGAL, EpCam, MUC17, TROP2, TETS |
| Colorectal cancer | A33, AFP, ALIX, ALX4, ANCA, APC, ASCA, AURKA, AURKB, B7H3, BANK1, BCNP, BDNF, CA-19-9, CCSA-2, CCSA-3&4, CD10, CD24, CD44, CD63, CD66 CEA, CD66e CEA, CD81, CD9, CDA, C-Erb2, CRMP-2, CRP, CRTN, CXCL12, CYFRA21-1, DcR3, DLL4, DR3, EGFR, Epcam, EphA2, FASL, FRT, GAL3, GDF15, GPCR (GPR110), GPR30, GRO-1, HBD 1, HBD2, HNP1-3, IL-1B, IL8, IMP3, L1CAM, LAMN, MACC-1, MGC20553, MCP-1, M-CSF, MIC1, MIF, MMP7, MMP9, MS4A1, MUC1, MUC17, MUC2, Ncam, NGAL, NNMT, OPN, p53, PCSA, PDGFRB, PRL, PSMA, PSME3, Reg IV, SCRN1, Sept-9, SPARC, SPON2, SPR, SRVN, TFF3, TGM2, TIMP-1, TMEM211, TNF-alpha, TPA, TPS, Trail-R2, Trail-R4, TrKB, TROP2, Tsg 101, TWEAK, UNC93A, VEGFA |
| Colorectal cancer | miR 92, miR 21, miR 9, miR 491 |
| Colorectal cancer | miR-127-3p, miR-92a, miR-486-3p, miR-378 |
| Colorectal cancer | TMEM211, MUC1, CD24 and/or GPR110 (GPCR 110) |
| Colorectal cancer | hsa-miR-376c, hsa-miR-215, hsa-miR-652, hsa-miR-582-5p, hsa-miR-324-5p, hsa-miR-1296, hsa-miR-28-5p, hsa-miR-190, hsa-miR-590-5p, hsa-miR-202, hsa-miR-195 |
| Colorectal cancer vesicle markers | A26C1A, A26C1B, A2M, ACAA2, ACE, ACOT7, ACP1, ACTA1, ACTA2, ACTB, ACTBL2, ACTBL3, ACTC1, ACTG1, ACTG2, ACTN1, ACTN2, ACTN4, ACTR3, ADAM10, ADSL, AGR2, AGR3, AGRN, AHCY, AHNAK, AKR1B10, ALB, ALDH16A1, ALDH1A1, ALDOA, ANXA1, ANXA11, ANXA2, ANXA2P2, ANXA4, ANXA5, ANXA6, AP2A1, AP2A2, APOA1, ARF1, ARF3, ARF4, ARF5, ARF6, ARHGDIA, ARPC3, ARPC5L, ARRDC1, ARVCF, ASCC3L1, ASNS, ATP1A1, ATP1A2, ATP1A3, ATP1B1, ATP4A, ATP5A1, ATP5B, ATP5I, ATP5L, ATP5O, ATP6AP2, B2M, BAIAP2, BAIAP2L1, BRI3BP, BSG, BUB3, C1orf58, C5orf32, CAD, CALM1, CALM2, CALM3, CAND1, CANX, CAPZA1, CBR1, CBR3, CCT2, CCT3, CCT4, CCT5, CCT6A, CCT7, CCT8, CD44, CD46, CD55, CD59, CD63, CD81, CD82, CD9, CDC42, CDH1, CDH17, CEACAM5, CFL1, CFL2, CHMP1A, CHMP2A, CHMP4B, CKB, CLDN3, CLDN4, CLDN7, CLIC1, CLIC4, CLSTN1, CLTC, CLTCL1, CLU, COL12A1, COPB1, COPB2, CORO1C, COX4I1, COX5B, CRYZ, CSPG4, CSRP1, CST3, CTNNA1, CTNNB1, CTNND1, CTTN, CYFIP1, DCD, DERA, DIP2A, DIP2B, DIP2C, DMBT1, DPEP1, DPP4, DYNC1H1, EDIL3, EEF1A1, EEF1A2, EEF1AL3, EEF1G, EEF2, EFNB1, EGFR, EHD1, EHD4, EIF3EIP, EIF3I, EIF4A1, EIF4A2, ENO1, ENO2, ENO3, EPHA2, EPHA5, EPHB1, EPHB2, EPHB3, EPHB4, EPPK1, ESD, EZR, F11R, F5, F7, FAM125A, FAM125B, |

TABLE 4-continued

Illustrative Biomarkers

| Illustrative Class | Biomarkers |
|---|---|
|  | FAM129B, FASLG, FASN, FAT, FCGBP, FER1L3, FKBP1A, FLNA, FLNB, FLOT1, FLOT2, G6PD, GAPDH, GARS, GCN1L1, GDI2, GK, GMDS, GNA13, GNAI2, GNAI3, GNAS, GNB1, GNB2, GNB2L1, GNB3, GNB4, GNG12, GOLGA7, GPA33, GPI, GPRC5A, GSN, GSTP1, H2AFJ, HADHA, hCG_1757335, HEPH, HIST1H2AB, HIST1H2AE, HIST1H2AJ, HIST1H2AK, HIST1H4A, HIST1H4B, HIST1H4C, HIST1H4D, HIST1H4E, HIST1H4F, HIST1H4H, HIST1H4I, HIST1H4J, HIST1H4K, HIST1H4L, HIST2H2AC, HIST2H4A, HIST2H4B, HIST3H2A, HIST4H4, HLA-A, HLA-A29.1, HLA-B, HLA-C, HLA-E, HLA-H, HNRNPA2B1, HNRNPH2, HPCAL1, HRAS, HSD17B4, HSP90AA1, HSP90AA2, HSP90AA4P, HSP90AB1, HSP90AB2P, HSP90AB3P, HSP90B1, HSPA1A, HSPA1B, HSPA1L, HSPA2, HSPA4, HSPA5, HSPA6, HSPA7, HSPA8, HSPA9, HSPD1, HSPE1, HSPG2, HYOU1, IDH1, IFITM1, IFITM2, IFITM3, IGH@, IGHG1, IGHG2, IGHG3, IGHG4, IGHM, IGHV4-31, IGK@, IGKC, IGKV1-5, IGKV2-24, IGKV3-20, IGSF3, IGSF8, IQGAP1, IQGAP2, ITGA2, ITGA3, ITGA6, ITGAV, ITGB1, ITGB4, JUP, KIAA0174, KIAA1199, KPNB1, KRAS, KRT1, KRT10, KRT13, KRT14, KRT15, KRT16, KRT17, KRT18, KRT19, KRT2, KRT20, KRT24, KRT25, KRT27, KRT28, KRT3, KRT4, KRT5, KRT6A, KRT6B, KRT6C, KRT7, KRT75, KRT76, KRT77, KRT79, KRT8, KRT9, LAMA5, LAMP1, LDHA, LDHB, LFNG, LGALS3, LGALS3BP, LGALS4, LIMA1, LIN7A, LIN7C, LOC100128936, LOC100130553, LOC100133382, LOC100133739, LOC284889, LOC388524, LOC388720, LOC442497, LOC653269, LRP4, LRPPRC, LRSAM1, LSR, LYZ, MAN1A1, MAP4K4, MARCKS, MARCKSL1, METRNL, MFGE8, MICA, MIF, MINK1, MITD1, MMP7, MOBKL1A, MSN, MTCH2, MUC13, MYADM, MYH10, MYH11, MYH14, MYH9, MYL6, MYL6B, MYO1C, MYO1D, NARS, NCALD, NCSTN, NEDD4, NEDD4L, NME1, NME2, NOTCH1, NQO1, NRAS, P4HB, PCBP1, PCNA, PCSK9, PDCD6, PDCD6IP, PDIA3, PDXK, PEBP1, PFN1, PGK1, PHB, PHB2, PKM2, PLEC1, PLEKHB2, PLSCR3, PLXNA1, PLXNB2, PPIA, PPIB, PPP2R1A, PRDX1, PRDX2, PRDX3, PRDX5, PRDX6, PRKAR2A, PRKDC, PRSS23, PSMA2, PSMC6, PSMD11, PSMD3, PSME3, PTGFRN, PTPRF, PYGB, QPCT, QSOX1, RAB10, RAB11A, RAB11B, RAB13, RAB14, RAB15, RAB1A, RAB1B, RAB2A, RAB33B, RAB35, RAB43, RAB4B, RAB5A, RAB5B, RAB5C, RAB6A, RAB6B, RAB7A, RAB8A, RAB8B, RAC1, RAC3, RALA, RALB, RAN, RANP1, RAP1A, RAP1B, RAP2A, RAP2B, RAP2C, RDX, REG4, RHOA, RHOC, RHOG, ROCK2, RP11-631M21.2, RPL10A, RPL12, RPL6, RPL8, RPLP0, RPLP0-like, RPLP1, RPLP2, RPN1, RPS13, RPS14, RPS15A, RPS16, RPS18, RPS20, RPS21, RPS27A, RPS3, RPS4X, RPS4Y1, RPS4Y2, RPS7, RPS8, RPSA, RPSAP15, RRAS, RRAS2, RUVBL1, RUVBL2, S100A10, S100A11, S100A14, S100A16, S100A6, S100P, SDC1, SDC4, SDCBP, SDCBP2, SERINC1, SERINC5, SERPINA1, SERPINF1, SETD4, SFN, SLC12A2, SLC12A7, SLC16A1, SLC1A5, SLC25A4, SLC25A5, SLC25A6, SLC29A1, SLC2A1, SLC3A2, SLC44A1, SLC7A5, SLC9A3R1, SMPDL3B, SNAP23, SND1, SOD1, SORT1, SPTAN1, SPTBN1, SSBP1, SSR4, TACSTD1, TAGLN2, TBCA, TCEB1, TCP1, TF, TFRC, THBS1, TJP2, TKT, TMED2, TNFSF10, TNIK, TNKS1BP1, TNPO3, TOLLIP, TOMM22, TPI1, TPM1, TRAP1, TSG101, TSPAN1, TSPAN14, TSPAN15, TSPAN6, TSPAN8, TSTA3, TTYH3, TUBA1A, TUBA1B, TUBA1C, TUBA3C, TUBA3D, TUBA3E, TUBA4A, TUBA4B, TUBAS, TUBB, TUBB2A, TUBB2B, TUBB2C, TUBB3, TUBB4, TUBB4Q, TUBB6, TUFM, TXN, UBA1, UBA52, UBB, UBC, UBE2N, UBE2V2, UGDH, UQCRC2, VAMP1, VAMP3, VAMP8, VCP, VIL1, VPS25, VPS28, VPS35, VPS36, VPS37B, VPS37C, WDR1, YWHAB, YWHAE, YWHAG, YWHAH, YWHAQ, YWHAZ |
| Colorectal Cancer | hsa-miR-16, hsa-miR-25, hsa-miR-125b, hsa-miR-451, hsa-miR-200c, hsa-miR-140-3p, hsa-miR-658, hsa-miR-370, hsa-miR-1296, hsa-miR-636, hsa-miR-502-5p |
| Breast cancer | miR-21, miR-155, miR-206, miR-122a, miR-210, miR-21, miR-155, miR-206, miR-122a, miR-210, let-7, miR-10b, miR-125a, miR-125b, miR-145, miR-143, miR-145, miR-1b |
| Breast cancer | GAS5 |
| Breast cancer | ER, PR, HER2, MUC1, EGFR, KRAS, B-Raf, CYP2D6, hsp70, MART-1, TRP, HER2, hsp70, MART-1, TRP, HER2, ER, PR, Class III b-tubulin, VEGFA, ETV6-NTRK3, BCA-225, hsp70, MART1, ER, VEGFA, Class III b-tubulin, HER2/neu (e.g., for Her2+ breast cancer), GPR30, ErbB4 (JM) isoform, MPR8, MISIIR, CD9, EphA2, EGFR, B7H3, PSM, PCSA, CD63, STEAP, CD81, ICAM1, A33, DR3, CD66e, MFG-E8, TROP-2, Mammaglobin, Hepsin, NPGP/NPFF2, PSCA, 5T4, NGAL, EpCam, neurokinin receptor-1 (NK-1 or NK-1R), NK-2, Pai-1, CD45, CD10, HER2/ERBB2, AGTR1, NPY1R, MUC1, ESA, CD133, GPR30, BCA225, CD24, CA15.3 (MUC1 secreted), CA27.29 (MUC1 secreted), NMDAR1, NMDAR2, MAGEA, CTAG1B, NY-ESO-1, SPB, SPC, NSE, PGP9.5, progesterone receptor (PR) or its isoform (PR(A) or PR(B)), P2RX7, NDUFB7, NSE, GAL3, osteopontin, CHI3L1, IC3b, mesothelin, SPA, AQP5, GPCR, hCEA-CAM, PTP IA-2, CABYR, TMEM211, ADAM28, UNC93A, MUC17, MUC2, IL10R-beta, BCMA, HVEM/TNFRSF14, Trappin-2, Elafin, ST2/IL1 R4, TNFRF14, CEACAM1, TPA1, LAMP, WF, WH1000, PECAM, BSA, TNFR |
| Breast cancer | CD9, MIS Rii, ER, CD63, MUC1, HER3, STAT3, VEGFA, BCA, CA125, CD24, EPCAM, ERB B4 |
| Breast cancer | CD10, NPGP/NPFF2, HER2/ERBB2, AGTR1, NPY1R, neurokinin receptor-1 (NK-1 or NK-1R), NK-2, MUC1, ESA, CD133, GPR30, BCA225, CD24, CA15.3 (MUC1 secreted), CA27.29 (MUC1 secreted), NMDAR1, NMDAR2, MAGEA, CTAG1B, NY-ESO-1 |
| Breast cancer | SPB, SPC, NSE, PGP9.5, CD9, P2RX7, NDUFB7, NSE, GAL3, osteopontin, CHI3L1, EGFR, B7H3, IC3b, MUC1, mesothelin, SPA, PCSA, CD63, STEAP, AQP5, CD81, DR3, PSM, GPCR, EphA2, hCEA-CAM, PTP IA-2, CABYR, TMEM211, ADAM28, UNC93A, A33, CD24, CD10, NGAL, EpCam, MUC17, TROP-2, MUC2, IL10R-beta, BCMA, HVEM/TNFRSF14, Trappin-2 Elafin, ST2/IL1 R4, TNFRF14, CEACAM1, TPA1, LAMP, WF, WH1000, PECAM, BSA, TNFR |

TABLE 4-continued

Illustrative Biomarkers

| Illustrative Class | Biomarkers |
|---|---|
| Breast cancer | BRCA, MUC-1, MUC 16, CD24, ErbB4, ErbB2 (HER2), ErbB3, HSP70, Mammaglobin, PR, PR(B), VEGFA |
| Breast cancer | CD9, HSP70, Gal3, MIS, EGFR, ER, ICB3, CD63, B7H4, MUC1, DLL4, CD81, ERB3, VEGF, BCA225, BRCA, CA125, CD174, CD24, ERB2, NGAL, GPR30, CYFRA21, CD31, cMET, MUC2, ERBB4 |
| Breast cancer | CD9, EphA2, EGFR, B7H3, PSMA, PCSA, CD63, STEAP, CD81, STEAP1, ICAM1 (CD54), PSMA, A33, DR3, CD66e, MFG-8e, TMEM211, TROP-2, EGFR, Mammoglobin, Hepsin, NPGP/NPFF2, PSCA, 5T4, NGAL, NK-2, EpCam, NK-1R, PSMA, 5T4, PAI-1, CD45 |
| Breast cancer | PGP9.5, CD9, HSP70, gal3-b2c10, EGFR, iC3b, PSMA, PCSA, CD63, MUC1, DLL4, CD81, B7-H3, HER 3 (ErbB3), MART-1, PSA, VEGF A, TIMP-1, GPCR GPR110, EphA2, MMP9, mmp7, TMEM211, UNC93a, BRCA, CA125 (MUC16), Mammaglobin, CD174 (Lewis y), CD66e CEA, CD24 c.sn3, C-erbB2, CD10, NGAL, epcam, CEA (carcinoembryonic Antigen), GPR30, CYFRA21-1, OPN, MUC17, hVEGFR2, MUC2, NCAM, ASPH, ErbB4, SPB, SPC, CD9, MS4A1, EphA2, MIS RII, HER2 (ErbB2), ER, PR (B), MRP8, CD63, B7H4, TGM2, CD81, DR3, STAT 3, MACC-1, TrKB, IL 6 Unc, OPG - 13, IL6R, EZH2, SCRN1, TWEAK, SERPINB3, CDAC1, BCA-225, DR3, A33, NPGP/NPFF2, TIMP1, BDNF, FRT, Ferritin heavy chain, seprase, p53, LDH, HSP, ost, p53, CXCL12, HAP, CRP, Gro-alpha, Tsg 101, GDF15 |
| Breast cancer | CD9, HSP70, Gal3, MIS (RII), EGFR, ER, ICB3, CD63, B7H4, MUC1, CD81, ERB3, MART1, STAT3, VEGF, BCA225, BRCA, CA125, CD174, CD24, ERB2, NGAL, GPR30, CYFRA21, CD31, cMET, MUC2, ERB4, TMEM211 |
| Breast Cancer | 5T4 (trophoblast), ADAM10, AGER/RAGE, APC, APP (β-amyloid), ASPH (A-10), B7H3 (CD276), BACE1, BAI3, BRCA1, BDNF, BIRC2, C1GALT1, CA125 (MUC16), Calmodulin 1, CCL2 (MCP-1), CD9, CD10, CD127 (IL7R), CD174, CD24, CD44, CD63, CD81, CEA, CRMP-2, CXCR3, CXCR4, CXCR6, CYFRA 21, derlin 1, DLL4, DPP6, E-CAD, EpCaM, EphA2 (H-77), ER(1) ESR1 α, ER(2) ESR2 β, Erb B4, Erbb2, erb3 (Erb-B3), PA2G4, FRT (FLT1), Gal3, GPR30 (G-coupled ER1), HAP1, HER3, HSP-27, HSP70, IC3b, IL8, insig, junction plakoglobin, Keratin 15, KRAS, Mammaglobin, MART1, MCT2, MFGE8, MMP9, MRP8, Muc1, MUC17, MUC2, NCAM, NG2 (CSPG4), Ngal, NHE-3, NT5E (CD73), ODC1, OPG, OPN, p53, PARK7, PCSA, PGP9.5 (PARK5), PR(B), PSA, PSMA, RAGE, STXBP4, Survivin, TFF3 (secreted), TIMP1, TIMP2, TMEM211, TRAF4 (scaffolding), TRAIL-R2 (death Receptor 5), TrkB, Tsg 101, UNC93a, VEGF A, VEGFR2, YB-1, VEGFR1, GCDPF-15 (PIP), BigH3 (TGFb1-induced protein), 5HT2B (serotonin receptor 2B), BRCA2, BACE 1, CDH1—cadherin |
| Breast Cancer | AK5.2, ATP6V1B1, CRABP1 |
| Breast Cancer | DST.3, GATA3, KRT81 |
| Breast Cancer | AK5.2, ATP6V1B1, CRABP1, DST.3, ELF5, GATA3, KRT81, LALBA, OXTR, RASL10A, SERHL, TFAP2A.1, TFAP2A.3, TFAP2C, VTCN1 |
| Breast Cancer | TRAP; Renal Cell Carcinoma; Filamin; 14.3.3, Pan; Prohibitin; c-fos; Ang-2; GSTmu; Ang-1; FHIT; Rad51; Inhibin alpha; Cadherin-P; 14.3.3 gamma; p18INK4c; P504S; XRCC2; Caspase 5; CREB-Binding Protein; Estrogen Receptor; IL17; Claudin 2; Keratin 8; GAPDH; CD1; Keratin, LMW; Gamma Glutamylcysteine Synthetase(GCS)/Glutamate-cysteine Ligase; a-B-Crystallin; Pax-5; MMP-19; APC; IL-3; Keratin 8 (phospho-specific Ser73); TGF-beta 2; ITK; Oct-2/; DJ-1; B7-H2; Plasma Cell Marker; Rad18; Estriol; Chk1; Prolactin Receptor; Laminin Receptor; Histone H1; CD45RO; GnRH Receptor; IP10/CRG2; Actin, Muscle Specific; S100; Dystrophin; Tubulin-a; CD3zeta; CDC37; GABA a Receptor 1; MMP-7 (Matrilysin); Heregulin; Caspase 3; CD56/NCAM-1; Gastrin 1; SREBP-1 (Sterol Regulatory Element Binding Protein-1); MLH1; PGP9.5; Factor VIII Related Antigen; ADP-ribosylation Factor (ARF-6); MHC II (HLA-DR) Ia; Survivin; CD23; G-CSF; CD2; kDa Calretinin; Neuron Specific Enolase; CD165; Calponin; CD95/Fas; Urocortin; Heat Shock Protein 27/hsp27; Topo II beta; Insulin Receptor; Keratin 5/8; sm; Actin, skeletal muscle; CA19-9; GluR1; GRIP1; CD79a mb-1; TdT; HRP; CD94; CCK-8; Thymidine Phosphorylase; CD57; Alkaline Phosphatase (AP); CD59/MACIF/MIRL/Protectin; GLUT-1; alpha-1-antitrypsin; Presenillin; Mucin 3 (MUC3); pS2; 14-3-3 beta; MMP-13 (Collagenase-3); Fli-1; mGluRS; Mast Cell Chymase; Laminin B1/b1; Neurofilament (160 kDa); CNPase; Amylin Peptide; Gail; CD6; alpha-1-antichymotrypsin; E2F-2; MyoD1 |
| Ductal carcinoma in situ (DCIS) | Laminin B1/b1; E2F-2; TdT; Apolipoprotein D; Granulocyte; Alkaline Phosphatase (AP); Heat Shock Protein 27/hsp27; CD95/Fas; pS2; Estriol; GLUT-1; Fibronectin; CD6; CCK-8; sm; Factor VIII Related Antigen; CD57; Plasminogen; CD71/Transferrin Receptor; Keratin 5/8; Thymidine Phosphorylase; CD45/T200/LCA; Epithelial Specific Antigen; Macrophage; CD10; MyoD1; Gail; bcl-XL; hPL; Caspase 3; Actin, skeletal muscle; IP10/CRG2; GnRH Receptor; p35nck5a; ADP-ribosylation Factor (ARF-6); Cdk4 ; alpha-1-antitrypsin; IL17; Neuron Specific Enolase; CD56/NCAM-1; Prolactin Receptor; Cdk7; CD79a mb-1; Collagen IV; CD94; Myeloid Specific Marker; Keratin 10; Pax-5; IgM (m-Heavy Chain); CD45RO; CA19-9; Mucin 2; Glucagon; Mast Cell Chymase; MLH1; CD1; CNPase; Parkin; MHC II (HLA-DR) Ia; B7-H2; Chk1; Lambda Light Chain; MHC II (HLA-DP and DR); Myogenin; MMP-7 (Matrilysin); Topo II beta; CD53; Keratin 19; Rad18; Ret Oncoprotein; MHC II (HLA-DP); E3-binding protein (ARM1); Progesterone Receptor; Keratin 8; IgG; IgA; Tubulin; Insulin Receptor Substrate-1; Keratin 15; DR3; IL-3; Keratin 10/13; Cyclin D3; MHC I (HLA25 and HLA-Aw32); Calmodulin; Neurofilament (160 kDa) |
| Ductal carcinoma in situ (DCIS) v. other Breast cancer | Macrophage; Fibronectin; Granulocyte; Keratin 19; Cyclin D3; CD45/T200/LCA; EGFR; Thrombospondin; CD81/TAPA-1; Ruv C; Plasminogen; Collagen IV; Laminin B1/b1; CD10; TdT; Filamin; bcl-XL; 14.3.3 gamma; 14.3.3, Pan; p170; Apolipoprotein D; CD71/Transferrin Receptor; FHIT |

TABLE 4-continued

Illustrative Biomarkers

| Illustrative Class | Biomarkers |
|---|---|
| Breast cancer | 5HT2B, 5T4 (trophoblast), ACO2, ACSL3, ACTN4, ADAM10, AGR2, AGR3, ALCAM, ALDH6A1, ANGPTL4, ANO9, AP1G1, APC, APEX1, APLP2, APP (_-amyloid), ARCN1, ARHGAP35, ARL3, ASAH1, ASPH (A-10), ATP1B1, ATP1B3, ATP5I, ATP5O, ATXN1, B7H3, BACE1, BAI3, BAIAP2, BCA-200, BDNF, BigH3, BIRC2, BLVRB, BRCA, BST2, C1GALT1, C1GALT1C1, C20orf3, CA125, CACYBP, Calmodulin, CAPN1, CAPNS1, CCDC64B, CCL2 (MCP-1), CCT3, CD10(BD), CD127 (IL7R), CD174, CD24, CD44, CD80, CD86, CDH1, CDH5, CEA, CFL2, CHCHD3, CHMP3, CHRDL2, CIB1, CKAP4, COPA, COX5B, CRABP2, CRIP1, CRISPLD1, CRMP-2, CRTAP, CTLA4, CUL3, CXCR3, CXCR4, CXCR6, CYB5B, CYB5R1, CYCS, CYFRA 21, DBI, DDX23, DDX39B, derlin 1, DHCR7, DHX9, DLD, DLL4, DNAJB1, DPP6, DSTN, eCadherin, EEF1D, EEF2, EFTUD2, EIF4A2, EIF4A3, EpCaM, EphA2, ER(1) ESR1_, ER(2) ESR2_, Erb B4, Erb2, erb3 (Erb-B3?), ERLIN2, ESD, FARSA, FASN, FEN1, FKBP5, FLNB, FOXP3, FUS, Gal3, GCDPF-15, GCNT2, GNA12, GNG5, GNPTG, GPC6, GPD2, GPER (GPR30), GSPT1, H3F3B, H3F3C, HADH, HAP1, HER3, HIST1H1C, HIST1H2AB, HIST1H3A, HIST1H3C, HIST1H3D, HIST1H3E, HIST1H3F, HIST1H3G, HIST1H3H, HIST1H3I, HIST1H3J, HIST2H2BF, HIST2H3A, HIST2H3C, HIST2H3D, HIST3H3, HMGB1, HNRNPA2B1, HNRNPAB, HNRNPC, HNRNPD, HNRNPH2, HNRNPK, HNRNPL, HNRNPM, HNRNPU, HPS3, HSP-27, HSP70, HSP90B1, HSPA1A, HSPA2, HSPA9, HSPE1, IC3b, IDE, IDH3B, IDO1, IFI30, IL1RL2, IL7, IL8, ILF2, ILF3, IQCG, ISOC2, IST1, ITGA7, ITGB7, junction plakoglobin, Keratin 15, KRAS, KRT19, KRT2, KRT7, KRT8, KRT9, KTN1, LAMP1, LMNA, LMNB1, LNPEP, LRPPRC, LRRC57, Mammaglobin, MAN1A1, MAN1A2, MART1, MATR3, MBD5, MCT2, MDH2, MFGE8, MFGE8, MGP, MMP9, MRP8, MUC1, MUC17, MUC2, MYO5B, MYOF, NAPA, NCAM, NCL, NG2 (CSPG4), Ngal, NHE-3, NME2, NONO, NPM1, NQO1, NT5E (CD73), ODC1, OPG, OPN (SC), OS9, p53, PACSIN3, PAICS, PARK7, PARVA, PC, PCNA, PCSA, PD-1, PD-L1, PD-L2, PGP9.5, PHB, PHB2, PIK3C2B, PKP3, PPL, PR(B)?, PRDX2, PRKCB, PRKCD, PRKDC, PSA, PSAP, PSMA, PSMB7, PSMD2, PSME3, PYCARD, RAB1A, RAB3D, RAB7A, RAGE, RBL2, RNPEP, RPL14, RPL27, RPL36, RPS25, RPS4X, RPS4Y1, RPS4Y2, RUVBL2, SET, SHMT2, SLAIN1, SLC39A14, SLC9A3R2, SMARCA4, SNRPD2, SNRPD3, SNX33, SNX9, SPEN, SPR, SQSTM1, SSBP1, ST3GAL1, STXBP4, SUB1, SUCLG2, Survivin, SYT9, TFF3 (secreted), TGOLN2, THBS1, TIMP1, TIMP2, TMED10, TMED4, TMED9, TMEM211, TOM1, TRAF4 (scaffolding), TRAIL-R2, TRAP1, TrkB, Tsg 101, TXNDC16, U2AF2, UEVLD, UFC1, UNC93a, USP14, VASP, VCP, VDAC1, VEGFA, VEGFR1, VEGFR2, VPS37C, WIZ, XRCC5, XRCC6, YB-1, YWHAZ |
| Lung cancer | Pgrmc1 (progesterone receptor membrane component 1)/sigma-2 receptor, STEAP, EZH2 |
| Lung cancer | Prohibitin, CD23, Amylin Peptide, HRP, Rad51, Pax-5, Oct-3/, GLUT-1, PSCA, Thrombospondin, FHIT, a-B-Crystallin, LewisA, Vacular Endothelial Growth Factor(VEGF), Hepatocyte Factor Homologue-4, Flt-4, GluR6/7, Prostate Apoptosis Response Protein-4, GluR1, Fli-1, Urocortin, S100A4, 14-3-3 beta, P504S, HDAC1, PGP9.5, DJ-1, COX2, MMP-19, Actin, skeletal muscle, Claudin 3, Cadherin-P, Collagen IX, p27Kip1, Cathepsin D, CD30 (Reed-Sternberg Cell Marker), Ubiquitin, FSH-b, TrxR2, CCK-8, Cyclin C, CD138, TGF-beta 2, Adrenocorticotrophic Hormone, PPAR-gamma, Bcl-6, GLUT-3, IGF-I, mRANKL, Fas-ligand, Filamin, Calretinin, O ct-1, Parathyroid Hormone, Claudin 5, Claudin 4, Raf-1 (Phospho-specific), CDC14A Phosphatase, Mitochondria, APC, Gastrin 1, Ku (p80), Gail, XPA, Maltose Binding Protein, Melanoma (gp100), Phosphotyrosine, Amyloid A, CXCR4/Fusin, Hepatic Nuclear Factor-36, Caspase 1, HPV 16-E7, Axonal Growth Cones, Lck, Ornithine Decarboxylase, Gamma Glutamylcysteine Synthetase(GCS)/Glutamate-cysteine Ligase, ERCC1, Calmodulin, Caspase 7 (Mch 3), CD137 (4-1BB), Nitric Oxide Synthase, brain (bNOS), E2F-2, IL-10R, L-Plastin, CD18, Vimentin, CD50/ICAM-3, Superoxide Dismutase, Adenovirus Type 5 E1A, PHAS-I, Progesterone Receptor (phospho-specific) - Serine 294, MHC II (HLA-DQ), XPG, ER Ca+2 ATPase2, Laminin-s, E3 -binding protein (ARM1), CD45RO, CD1, Cdk2, MMP-10 (Stromilysin-2), sm, Surfactant Protein B (Pro), Apolipoprotein D, CD46, Keratin 8 (phospho-specific Ser73), PCNA, FLAP, CD20, Syk, LH, Keratin 19, ADP-ribosylation Factor (ARF-6), Int-2 Oncoprotein, Luciferase, AIF (Apoptosis Inducing Factor), Grb2, bcl-X, CD16, Paxillin, MHC II (HLA-DP and DR), B-Cell, p21WAF1, MHC II (HLA-DR), Tyrosinase, E2F-1, Pds1, Calponin, Notch, CD26/DPP IV, SV40 Large T Antigen, Ku (p70/p80), Perform, XPF, SIM Ag (SIMA-4D3), Cdk1/p34cdc2, Neuron Specific Enolase, b-2-Microglobulin, DNA Polymerase Beta, Thyroid Hormone Receptor, Human, Alkaline Phosphatase (AP), Plasma Cell Marker, Heat Shock Protein 70/hsp70, TRP75/gp75, SRF (Serum Response Factor), Laminin B1/b1, Mast Cell Chymase, Caldesmon, CEA/CD66e, CD24, Retinoid X Receptor (hRXR), CD45/T200/LCA, Rabies Virus, Cytochrome c, DR3, bcl-XL, Fascin, CD71/Transferrin Receptor |
| Lung Cancer | miR-497 |
| Lung Cancer | Pgrmc1 |
| Ovarian Cancer | CA-125, CA 19-9, c-reactive protein, CD95(also called Fas, Fas antigen, Fas receptor, FasR, TNFRSF6, APT1 or APO-1), FAP-1, miR-200 microRNAs, EGFR, EGFRvIII, apolipoprotein AI, apolipoprotein CIII, myoglobin, tenascin C, MSH6, claudin-3, claudin-4, caveolin-1, coagulation factor III, CD9, CD36, CD37, CD53, CD63, CD81, CD136, CD147, Hsp70, Hsp90, Rab13, Desmocollin-1, EMP-2, CK7, CK20, GCDF15, CD82, Rab-5b, Annexin V, MFG-E8, HLA-DR. MiR-200 microRNAs (miR-200a, miR-200b, miR-200c), miR-141, miR-429, JNK, Jun |
| Prostate Cancer v normal | AQP2, BMP5, C16orf86, CXCL13, DST, ERCC1, GNAO1, KLHL5, MAP4K1, NELL2, PENK, PGF, POU3F1, PRSS21, SCML1, SEMG1, SMARCD3, SNAI2, TAF1C, TNNT3 |
| Prostate Cancer v Breast Cancer | ADRB2, ARG2, C22orf32, CYorf14, EIF1AY, FEV, KLK2, KLK4, LRRC26, MAOA, NLGN4Y, PNPLA7, PVRL3, SIM2, SLC30A4, SLC45A3, STX19, TRIM36, TRPM8 |

TABLE 4-continued

Illustrative Biomarkers

| Illustrative Class | Biomarkers |
|---|---|
| Prostate Cancer v Colorectal Cancer | ADRB2, BAIAP2L2, C19orf33, CDX1, CEACAM6, EEF1A2, ERN2, FAM110B, FOXA2, KLK2, KLK4, LOC389816, LRRC26, MIPOL1, SLC45A3, SPDEF, TRIM31, TRIM36, ZNF613 |
| Prostate Cancer v Lung Cancer | ASTN2, CAB39L, CRIP1, FAM110B, FEV, GSTP1, KLK2, KLK4, LOC389816, LRRC26, MUC1, PNPLA7, SIM2, SLC45A3, SPDEF, TRIM36, TRPV6, ZNF613 |
| Prostate Cancer | miRs-26a + b, miR-15, miR-16, miR-195, miR-497, miR-424, miR-206, miR-342-5p, miR-186, miR-1271, miR-600, miR-216b, miR-519 family, miR-203 |
| Integrins | ITGA1 (CD49a, VLA1), ITGA2 (CD49b, VLA2), ITGA3 (CD49c, VLA3), ITGA4 (CD49d, VLA4), ITGA5 (CD49e, VLA5), ITGA6 (CD49f, VLA6), ITGA7 (FLJ25220), ITGA8, ITGA9 (RLC), ITGA10, ITGA11 (HsT18964), ITGAD (CD11D, FLJ39841), ITGAE (CD103, HUMINAE), ITGAL (CD11a, LFA1A), ITGAM (CD11b, MAC-1), ITGAV (CD51, VNRA, MSK8), ITGAW, ITGAX (CD11c), ITGB1 (CD29, FNRB, MSK12, MDF20), ITGB2 (CD18, LFA-1, MAC-1, MFI7), ITGB3 (CD61, GP3A, GPIIIa), ITGB4 (CD104), ITGB5 (FLJ26658), ITGB6, ITGB7, ITGB8 |
| Glycoprotein | GpIa-IIa, GpIIb-IIIa, GpIIIb, GpIb, GpIX |
| Transcription factors | STAT3, EZH2, p53, MACC1, SPDEF, RUNX2, YB-1 |
| Kinases | AURKA, AURKB |
| Disease Markers | 6Ckine, Adiponectin, Adrenocorticotropic Hormone, Agouti-Related Protein, Aldose Reductase, Alpha-1-Antichymotrypsin, Alpha-1-Antitrypsin, Alpha-1-Microglobulin, Alpha-2-Macroglobulin, Alpha-Fetoprotein, Amphiregulin, Angiogenin, Angiopoietin-2, Angiotensin-Converting Enzyme, Angiotensinogen, Annexin A1, Apolipoprotein A-I, Apolipoprotein A-II, Apolipoprotein A-IV, Apolipoprotein B, Apolipoprotein C-I, Apolipoprotein C-III, Apolipoprotein D, Apolipoprotein E, Apolipoprotein H, Apolipoprotein(a), AXL Receptor Tyrosine Kinase, B cell-activating Factor, B Lymphocyte Chemoattractant, Bcl-2-like protein 2, Beta-2-Microglobulin, Betacellulin, Bone Morphogenetic Protein 6, Brain-Derived Neurotrophic Factor, Calbindin, Calcitonin, Cancer Antigen 125, Cancer Antigen 15-3, Cancer Antigen 19-9, Cancer Antigen 72-4, Carcinoembryonic Antigen, Cathepsin D, CD 40 antigen, CD40 Ligand, CD5 Antigen-like, Cellular Fibronectin, Chemokine CC-4, Chromogranin-A, Ciliary Neurotrophic Factor, Clusterin, Collagen IV, Complement C3, Complement Factor H, Connective Tissue Growth Factor, Cortisol, C-Peptide, C-Reactive Protein, Creatine Kinase-MB, Cystatin-C, Endoglin, Endostatin, Endothelin-1, EN-RAGE, Eotaxin-1, Eotaxin-2, Eotaxin-3, Epidermal Growth Factor, Epiregulin, Epithelial cell adhesion molecule, Epithelial-Derived Neutrophil-Activating Protein 78, Erythropoietin, E-Selectin, Ezrin, Factor VII, Fas Ligand, FASLG Receptor, Fatty Acid-Binding Protein (adipocyte), Fatty Acid-Binding Protein (heart), Fatty Acid-Binding Protein (liver), Ferritin, Fetuin-A, Fibrinogen, Fibroblast Growth Factor 4, Fibroblast Growth Factor basic, Fibulin-1C, Follicle-Stimulating Hormone, Galectin-3, Gelsolin, Glucagon, Glucagon-like Peptide 1, Glucose-6-phosphate Isomerase, Glutamate-Cysteine Ligase Regulatory subunit, Glutathione S-Transferase alpha, Glutathione S-Transferase Mu 1, Granulocyte Colony-Stimulating Factor, Granulocyte-Macrophage Colony-Stimulating Factor, Growth Hormone, Growth-Regulated alpha protein, Haptoglobin, HE4, Heat Shock Protein 60, Heparin-Binding EGF-Like Growth Factor, Hepatocyte Growth Factor, Hepatocyte Growth Factor Receptor, Hepsin, Human Chorionic Gonadotropin beta, Human Epidermal Growth Factor Receptor 2, Immunoglobulin A, Immunoglobulin E, Immunoglobulin M, Insulin, Insulin-like Growth Factor I, Insulin-like Growth Factor-Binding Protein 1, Insulin-like Growth Factor-Binding Protein 2, Insulin-like Growth Factor-Binding Protein 3, Insulin-like Growth Factor Binding Protein 4, Insulin-like Growth Factor Binding Protein 5, Insulin-like Growth Factor Binding Protein 6, Intercellular Adhesion Molecule 1, Interferon gamma, Interferon gamma Induced Protein 10, Interferon-inducible T-cell alpha chemoattractant, Interleukin-1 alpha, Interleukin-1 beta, Interleukin-1 Receptor antagonist, Interleukin-2, Interleukin-2 Receptor alpha, Interleukin-3, Interleukin-4, Interleukin-5, Interleukin-6, Interleukin-6 Receptor, Interleukin-6 Receptor subunit beta, Interleukin-7, Interleukin-8, Interleukin-10, Interleukin-11, Interleukin-12 Subunit p40, Interleukin-12 Subunit p70, Interleukin-13, Interleukin-15, Interleukin-16, Interleukin-25, Kallikrein 5, Kallikrein-7, Kidney Injury Molecule-1, Lactoylglutathione lyase, Latency-Associated Peptide of Transforming Growth Factor beta 1, Lectin-Like Oxidized LDL Receptor 1, Leptin, Luteinizing Hormone, Lymphotactin, Macrophage Colony-Stimulating Factor 1, Macrophage Inflammatory Protein-1 alpha, Macrophage Inflammatory Protein-1 beta, Macrophage Inflammatory Protein-3 alpha, Macrophage inflammatory protein 3 beta, Macrophage Migration Inhibitory Factor, Macrophage-Derived Chemokine, Macrophage-Stimulating Protein, Malondialdehyde-Modified Low-Density Lipoprotein, Maspin, Matrix Metalloproteinase-1, Matrix Metalloproteinase-2, Matrix Metalloproteinase-3, Matrix Metalloproteinase-7, Matrix Metalloproteinase-9, Matrix Metalloproteinase-9, Matrix Metalloproteinase-10, Mesothelin, MHC class I chain-related protein A, Monocyte Chemotactic Protein 1, Monocyte Chemotactic Protein 2, Monocyte Chemotactic Protein 3, Monocyte Chemotactic Protein 4, Monokine Induced by Gamma Interferon, Myeloid Progenitor Inhibitory Factor 1, Myeloperoxidase, Myoglobin, Nerve Growth Factor beta, Neuronal Cell Adhesion Molecule, Neuron-Specific Enolase, Neuropilin-1, Neutrophil Gelatinase-Associated Lipocalin, NT-proBNP, Nucleoside diphosphate kinase B, Osteopontin, Osteoprotegerin, Pancreatic Polypeptide, Pepsinogen I, Peptide YY, Peroxiredoxin-4, Phosphoserine Aminotransferase, Placenta Growth Factor, Plasminogen Activator Inhibitor 1, Platelet-Derived Growth Factor BB, Pregnancy-Associated Plasma Protein A, Progesterone, Proinsulin (inc. Total or Intact), Prolactin, Prostasin, Prostate-Specific Antigen (inc. Free PSA), Prostatic Acid Phosphatase, Protein S100-A4, Protein S100-A6, Pulmonary and Activation-Regulated Chemokine, Receptor for advanced |

TABLE 4-continued

Illustrative Biomarkers

| Illustrative Class | Biomarkers |
|---|---|
| | glycosylation end products, Receptor tyrosine-protein kinase erbB-3, Resistin, S100 calcium-binding protein B, Secretin, Serotransferrin, Serum Amyloid P-Component, Serum Glutamic Oxaloacetic Transaminase, Sex Hormone-Binding Globulin, Sortilin, Squamous Cell Carcinoma Antigen-1, Stem Cell Factor, Stromal cell-derived Factor-1, Superoxide Dismutase 1 (soluble), T Lymphocyte-Secreted Protein I-309, Tamm-Horsfall Urinary Glycoprotein, T-Cell-Specific Protein RANTES, Tenascin-C, Testosterone, Tetranectin, Thrombomodulin, Thrombopoietin, Thrombospondin-1, Thyroglobulin, Thyroid-Stimulating Hormone, Thyroxine-Binding Globulin, Tissue Factor, Tissue Inhibitor of Metalloproteinases 1, Tissue type Plasminogen activator, TNF-Related Apoptosis-Inducing Ligand Receptor 3, Transforming Growth Factor alpha, Transforming Growth Factor beta-3, Transthyretin, Trefoil Factor 3, Tumor Necrosis Factor alpha, Tumor Necrosis Factor beta, Tumor Necrosis Factor Receptor I, Tumor necrosis Factor Receptor 2, Tyrosine kinase with Ig and EGF homology domains 2, Urokinase-type Plasminogen Activator, Urokinase-type plasminogen activator Receptor, Vascular Cell Adhesion Molecule-1, Vascular Endothelial Growth Factor, Vascular endothelial growth Factor B, Vascular Endothelial Growth Factor C, Vascular endothelial growth Factor D, Vascular Endothelial Growth Factor Receptor 1, Vascular Endothelial Growth Factor Receptor 2, Vascular endothelial growth Factor Receptor 3, Vitamin K-Dependent Protein S, Vitronectin, von Willebrand Factor, YKL-40 |
| Disease Markers | Adiponectin, Adrenocorticotropic Hormone, Agouti-Related Protein, Alpha-1-Antichymotrypsin, Alpha-1-Antitrypsin, Alpha-1-Microglobulin, Alpha-2-Macroglobulin, Alpha-Fetoprotein, Amphiregulin, Angiopoietin-2, Angiotensin-Converting Enzyme, Angiotensinogen, Apolipoprotein A-I, Apolipoprotein A-II, Apolipoprotein A-IV, Apolipoprotein B, Apolipoprotein C-I, Apolipoprotein C-III, Apolipoprotein D, Apolipoprotein E, Apolipoprotein H, Apolipoprotein(a), AXL Receptor Tyrosine Kinase, B Lymphocyte Chemoattractant, Beta-2-Microglobulin, Betacellulin, Bone Morphogenetic Protein 6, Brain-Derived Neurotrophic Factor, Calbindin, Calcitonin, Cancer Antigen 125, Cancer Antigen 19-9, Carcinoembryonic Antigen, CD 40 antigen, CD40 Ligand, CD5 Antigen-like, Chemokine CC-4, Chromogranin-A, Ciliary Neurotrophic Factor, Clusterin, Complement C3, Complement Factor H, Connective Tissue Growth Factor, Cortisol, C-Peptide, C-Reactive Protein, Creatine Kinase-MB, Cystatin-C, Endothelin-1, EN-RAGE, Eotaxin-1, Eotaxin-3, Epidermal Growth Factor, Epiregulin, Epithelial-Derived Neutrophil-Activating Protein 78, Erythropoietin, E-Selectin, Factor VII, Fas Ligand, FASLG Receptor, Fatty Acid-Binding Protein (heart), Ferritin, Fetuin-A, Fibrinogen, Fibroblast Growth Factor 4, Fibroblast Growth factor basic, Follicle-Stimulating Hormone, Glucagon, Glucagon-like Peptide 1, Glutathione S-Transferase alpha, Granulocyte Colony-Stimulating Factor, Granulocyte-Macrophage Colony-Stimulating Factor, Growth Hormone, Growth-Regulated alpha protein, Haptoglobin, Heat Shock Protein 60, Heparin-Binding EGF-Like Growth Factor, Hepatocyte Growth Factor, Immunoglobulin A, Immunoglobulin E, Immunoglobulin M, Insulin, Insulin-like Growth Factor I, Insulin-like Growth Factor-Binding Protein 2, Intercellular Adhesion Molecule 1, Interferon gamma, Interferon gamma Induced Protein 10, Interleukin-1 alpha, Interleukin-1 beta, Interleukin-1 Receptor antagonist, Interleukin-2, Interleukin-3, Interleukin-4, Interleukin-5, Interleukin-6, Interleukin-6 Receptor, Interleukin-7, Interleukin-8, Interleukin-10, Interleukin-11, Interleukin-12 Subunit p40, Interleukin-12 Subunit p70, Interleukin-13, Interleukin-15, Interleukin-16, Interleukin-25, Kidney Injury Molecule-1, Lectin-Like Oxidized LDL Receptor 1, Leptin, Luteinizing Hormone, Lymphotactin, Macrophage Colony-Stimulating Factor 1, Macrophage Inflammatory Protein-1 alpha, Macrophage Inflammatory Protein-1 beta, Macrophage Inflammatory Protein-3 alpha, Macrophage Migration Inhibitory Factor, Macrophage-Derived Chemokine, Malondialdehyde-Modified Low-Density Lipoprotein, Matrix Metalloproteinase-1, Matrix Metalloproteinase-2, Matrix Metalloproteinase-3, Matrix Metalloproteinase-7, Matrix Metalloproteinase-9, Matrix Metalloproteinase-9, Matrix Metalloproteinase-10, Monocyte Chemotactic Protein 1, Monocyte Chemotactic Protein 2, Monocyte Chemotactic Protein 3, Monocyte Chemotactic Protein 4, Monokine Induced by Gamma Interferon, Myeloid Progenitor Inhibitory Factor 1, Myeloperoxidase, Myoglobin, Nerve Growth Factor beta, Neuronal Cell Adhesion Molecule, Neutrophil Gelatinase-Associated Lipocalin, NT-proBNP, Osteopontin, Pancreatic Polypeptide, Peptide YY, Placenta Growth Factor, Plasminogen Activator Inhibitor 1, Platelet-Derived Growth Factor BB, Pregnancy-Associated Plasma Protein A, Progesterone, Proinsulin (inc. Intact or Total), Prolactin, Prostate-Specific Antigen (inc. Free PSA), Prostatic Acid Phosphatase, Pulmonary and Activation-Regulated Chemokine, Receptor for advanced glycosylation end products, Resistin, S100 calcium-binding protein B, Secretin, Serotransferrin, Serum Amyloid P-Component, Serum Glutamic Oxaloacetic Transaminase, Sex Hormone-Binding Globulin, Sortilin, Stem Cell Factor, Superoxide Dismutase 1 (soluble), T Lymphocyte-Secreted Protein I-309, Tamm-Horsfall Urinary Glycoprotein, T-Cell-Specific Protein RANTES, Tenascin-C, Testosterone, Thrombomodulin, Thrombopoietin, Thrombospondin-1, Thyroid-Stimulating Hormone, Thyroxine-Binding Globulin, Tissue Factor, Tissue Inhibitor of Metalloproteinases 1, TNF-Related Apoptosis-Inducing Ligand Receptor 3, Transforming Growth Factor alpha, Transforming Growth Factor beta-3, Transthyretin, Trefoil Factor 3, Tumor Necrosis Factor alpha, Tumor Necrosis Factor beta, Tumor necrosis Factor Receptor 2, Vascular Cell Adhesion Molecule-1, Vascular Endothelial Growth Factor, Vitamin K-Dependent Protein S, Vitronectin, von Willebrand Factor |
| Oncology | 6Ckine, Aldose Reductase, Alpha-Fetoprotein, Amphiregulin, Angiogenin, Annexin A1, B cell-activating Factor, B Lymphocyte Chemoattractant, Bcl-2-like protein 2, Betacellulin, Cancer Antigen 125, Cancer Antigen 15-3, Cancer Antigen 19-9, Cancer Antigen 72-4, Carcinoembryonic Antigen, Cathepsin D, Cellular Fibronectin, Collagen IV, Endoglin, Endostatin, Eotaxin-2, Epidermal Growth Factor, Epiregulin, Epithelial cell adhesion |

TABLE 4-continued

Illustrative Biomarkers

| Illustrative Class | Biomarkers |
|---|---|
| | molecule, Ezrin, Fatty Acid-Binding Protein (adipocyte), Fatty Acid-Binding Protein (liver), Fibroblast Growth Factor basic, Fibulin-1C, Galectin-3, Gelsolin, Glucose-6-phosphate Isomerase, Glutamate-Cysteine Ligase Regulatory subunit, Glutathione S-Transferase Mu 1, HE4, Heparin-Binding EGF-Like Growth Factor, Hepatocyte Growth Factor, Hepatocyte Growth Factor Receptor, Hepsin, Human Chorionic Gonadotropin beta, Human Epidermal Growth Factor Receptor 2, Insulin-like Growth Factor-Binding Protein 1, Insulin-like Growth Factor-Binding Protein 2, Insulin-like Growth Factor-Binding Protein 3, Insulin-like Growth Factor Binding Protein 4, Insulin-like Growth Factor Binding Protein 5, Insulin-like Growth Factor Binding Protein 6, Interferon gamma Induced Protein 10, Interferon-inducible T-cell alpha chemoattractant, Interleukin-2 Receptor alpha, Interleukin-6, Interleukin-6 Receptor subunit beta, Kallikrein 5, Kallikrein-7, Lactoylglutathione lyase, Latency-Associated Peptide of Transforming Growth Factor beta 1, Leptin, Macrophage inflammatory protein 3 beta, Macrophage Migration Inhibitory Factor, Macrophage-Stimulating Protein, Maspin, Matrix Metalloproteinase-2, Mesothelin, MHC class I chain-related protein A, Monocyte Chemotactic Protein 1, Monokine Induced by Gamma Interferon, Neuron-Specific Enolase, Neuropilin-1, Neutrophil Gelatinase-Associated Lipocalin, Nucleoside diphosphate kinase B, Osteopontin, Osteoprotegerin, Pepsinogen I, Peroxiredoxin-4, Phosphoserine Aminotransferase, Placenta Growth Factor, Platelet-Derived Growth Factor BB, Prostasin, Protein S100-A4, Protein S100-A6, Receptor tyrosine-protein kinase erbB-3, Squamous Cell Carcinoma Antigen-1, Stromal cell-derived Factor-1, Tenascin-C, Tetranectin, Thyroglobulin, Tissue type Plasminogen activator, Transforming Growth Factor alpha, Tumor Necrosis Factor Receptor I, Tyrosine kinase with Ig and EGF homology domains 2, Urokinase-type Plasminogen Activator, Urokinase-type plasminogen activator Receptor, Vascular Endothelial Growth Factor, Vascular endothelial growth Factor B, Vascular Endothelial Growth Factor C, Vascular endothelial growth Factor D, Vascular Endothelial Growth Factor Receptor 1, Vascular Endothelial Growth Factor Receptor 2, Vascular endothelial growth Factor Receptor 3, YKL-40 |
| Disease | Adiponectin, Alpha-1-Antitrypsin, Alpha-2-Macroglobulin, Alpha-Fetoprotein, Apolipoprotein A-I, Apolipoprotein C-III, Apolipoprotein H, Apolipoprotein(a), Beta-2-Microglobulin, Brain-Derived Neurotrophic Factor, Calcitonin, Cancer Antigen 125, Cancer Antigen 19-9, Carcinoembryonic Antigen, CD 40 antigen, CD40 Ligand, Complement C3, C-Reactive Protein, Creatine Kinase-MB, Endothelin-1, EN-RAGE, Eotaxin-1, Epidermal Growth Factor, Epithelial-Derived Neutrophil-Activating Protein 78, Erythropoietin, Factor VII, Fatty Acid-Binding Protein (heart), Ferritin, Fibrinogen, Fibroblast Growth Factor basic, Granulocyte Colony-Stimulating Factor, Granulocyte-Macrophage Colony-Stimulating Factor, Growth Hormone, Haptoglobin, Immunoglobulin A, Immunoglobulin E, Immunoglobulin M, Insulin, Insulin-like Growth Factor I, Intercellular Adhesion Molecule 1, Interferon gamma, Interleukin-1 alpha, Interleukin-1 beta, Interleukin-1 Receptor antagonist, Interleukin-2, Interleukin-3, Interleukin-4, Interleukin-5, Interleukin-6, Interleukin-7, Interleukin-8, Interleukin-10, Interleukin-12 Subunit p40, Interleukin-12 Subunit p70, Interleukin-13, Interleukin-15, Interleukin-16, Leptin, Lymphotactin, Macrophage Inflammatory Protein-1 alpha, Macrophage Inflammatory Protein-1 beta, Macrophage-Derived Chemokine, Matrix Metalloproteinase-2, Matrix Metalloproteinase-3, Matrix Metalloproteinase-9, Monocyte Chemotactic Protein 1, Myeloperoxidase, Myoglobin, Plasminogen Activator Inhibitor 1, Pregnancy-Associated Plasma Protein A, Prostate-Specific Antigen (inc. Free PSA), Prostatic Acid Phosphatase, Serum Amyloid P-Component, Serum Glutamic Oxaloacetic Transaminase, Sex Hormone-Binding Globulin, Stem Cell Factor, T-Cell- Specific Protein RANTES, Thrombopoietin, Thyroid-Stimulating Hormone, Thyroxine-Binding Globulin, Tissue Factor, Tissue Inhibitor of Metalloproteinases 1, Tumor Necrosis Factor alpha, Tumor Necrosis Factor beta, Tumor Necrosis Factor Receptor 2, Vascular Cell Adhesion Molecule-1, Vascular Endothelial Growth Factor, von Willebrand Factor |
| Neurological | Alpha-1-Antitrypsin, Apolipoprotein A-I, Apolipoprotein A-II, Apolipoprotein B, Apolipoprotein C-I, Apolipoprotein H, Beta-2-Microglobulin, Betacellulin, Brain-Derived Neurotrophic Factor, Calbindin, Cancer Antigen 125, Carcinoembryonic Antigen, CD5 Antigen-like, Complement C3, Connective Tissue Growth Factor, Cortisol, Endothelin-1, Epidermal Growth Factor Receptor, Ferritin, Fetuin-A, Follicle-Stimulating Hormone, Haptoglobin, Immunoglobulin A, Immunoglobulin M, Intercellular Adhesion Molecule 1, Interleukin-6 Receptor, Interleukin-7, Interleukin-10, Interleukin-11, Interleukin-17, Kidney Injury Molecule-1, Luteinizing Hormone, Macrophage-Derived Chemokine, Macrophage Migration Inhibitory Factor, Macrophage Inflammatory Protein-1 alpha, Matrix Metalloproteinase-2, Monocyte Chemotactic Protein 2, Peptide YY, Prolactin, Prostatic Acid Phosphatase, Serotransferrin, Serum Amyloid P-Component, Sortilin, Testosterone, Thrombopoietin, Thyroid-Stimulating Hormone, Tissue Inhibitor of Metalloproteinases 1, TNF-Related Apoptosis-Inducing Ligand Receptor 3, Tumor necrosis Factor Receptor 2, Vascular Endothelial Growth Factor, Vitronectin |
| Cardiovascular | Adiponectin, Apolipoprotein A-I, Apolipoprotein B, Apolipoprotein C-III, Apolipoprotein D, Apolipoprotein E, Apolipoprotein H, Apolipoprotein(a), Clusterin, C-Reactive Protein, Cystatin-C, EN-RAGE, E-Selectin, Fatty Acid-Binding Protein (heart), Ferritin, Fibrinogen, Haptoglobin, Immunoglobulin M, Intercellular Adhesion Molecule 1, Interleukin-6, Interleukin-8, Lectin-Like Oxidized LDL Receptor 1, Leptin, Macrophage Inflammatory Protein-1 alpha, Macrophage Inflammatory Protein-1 beta, Malondialdehyde-Modified Low-Density Lipoprotein, Matrix Metalloproteinase-1, Matrix Metalloproteinase-10, Matrix Metalloproteinase-2, Matrix Metalloproteinase-3, Matrix Metalloproteinase-7, Matrix Metalloproteinase-9, Monocyte Chemotactic Protein 1, Myeloperoxidase, Myoglobin, NT-proBNP, Osteopontin, Plasminogen Activator Inhibitor 1, P-Selectin, Receptor for advanced |

TABLE 4-continued

Illustrative Biomarkers

| Illustrative Class | Biomarkers |
|---|---|
| | glycosylation end products, Serum Amyloid P-Component, Sex Hormone-Binding Globulin, T-Cell-Specific Protein RANTES, Thrombomodulin, Thyroxine-Binding Globulin, Tissue Inhibitor of Metalloproteinases 1, Tumor Necrosis Factor alpha, Tumor necrosis Factor Receptor 2, Vascular Cell Adhesion Molecule-1, von Willebrand Factor |
| Inflammatory | Alpha-1-Antitrypsin, Alpha-2-Macroglobulin, Beta-2-Microglobulin, Brain-Derived Neurotrophic Factor, Complement C3, C-Reactive Protein, Eotaxin-1, Factor VII, Ferritin, Fibrinogen, Granulocyte-Macrophage Colony-Stimulating Factor, Haptoglobin, Intercellular Adhesion Molecule 1, Interferon gamma, Interleukin-1 alpha, Interleukin-1 beta, Interleukin-1 Receptor antagonist, Interleukin-2, Interleukin-3, Interleukin-4, Interleukin-5, Interleukin-6, Interleukin-7, Interleukin-8, Interleukin-10, Interleukin-12 Subunit p40, Interleukin-12 Subunit p70, Interleukin-15, Interleukin-17, Interleukin-23, Macrophage Inflammatory Protein-1 alpha, Macrophage Inflammatory Protein-1 beta, Matrix Metalloproteinase-2, Matrix Metalloproteinase-3, Matrix Metalloproteinase-9, Monocyte Chemotactic Protein 1, Stem Cell Factor, T-Cell-Specific Protein RANTES, Tissue Inhibitor of Metalloproteinases 1, Tumor Necrosis Factor alpha, Tumor Necrosis Factor beta, Tumor necrosis Factor Receptor 2, Vascular Cell Adhesion Molecule-1, Vascular Endothelial Growth Factor, Vitamin D-Binding Protein, von Willebrand Factor |
| Metabolic | Adiponectin, Adrenocorticotropic Hormone, Angiotensin-Converting Enzyme, Angiotensinogen, Complement C3 alpha des arg, Cortisol, Follicle-Stimulating Hormone, Galanin, Glucagon, Glucagon-like Peptide 1, Insulin, Insulin-like Growth Factor I, Leptin, Luteinizing Hormone, Pancreatic Polypeptide, Peptide YY, Progesterone, Prolactin, Resistin, Secretin, Testosterone |
| Kidney | Alpha-1-Microglobulin, Beta-2-Microglobulin, Calbindin, Clusterin, Connective Tissue Growth Factor, Creatinine, Cystatin-C, Glutathione S-Transferase alpha, Kidney Injury Molecule-1, Microalbumin, Neutrophil Gelatinase-Associated Lipocalin, Osteopontin, Tamm-Horsfall Urinary Glycoprotein, Tissue Inhibitor of Metalloproteinases 1, Trefoil Factor 3, Vascular Endothelial Growth Factor |
| Cytokines | Granulocyte-Macrophage Colony-Stimulating Factor, Interferon gamma, Interleukin-2, Interleukin-3, Interleukin-4, Interleukin-5, Interleukin-6, Interleukin-7, Interleukin-8, Interleukin-10, Macrophage Inflammatory Protein-1 alpha, Macrophage Inflammatory Protein-1 beta, Matrix Metalloproteinase-2, Monocyte Chemotactic Protein 1, Tumor Necrosis Factor alpha, Tumor Necrosis Factor beta, Brain-Derived Neurotrophic Factor, Eotaxin-1, Intercellular Adhesion Molecule 1, Interleukin-1 alpha, Interleukin-1 beta, Interleukin-1 Receptor antagonist, Interleukin-12 Subunit p40, Interleukin-12 Subunit p70, Interleukin-15, Interleukin-17, Interleukin-23, Matrix Metalloproteinase-3, Stem Cell Factor, Vascular Endothelial Growth Factor |
| Protein | 14.3.3 gamma, 14.3.3 (Pan), 14-3-3 beta, 6-Histidine, a-B-Crystallin, Acinus, Actin beta, Actin (Muscle Specific), Actin (Pan), Actin (skeletal muscle), Activin Receptor Type II, Adenovirus, Adenovirus Fiber, Adenovirus Type 2 E1A, Adenovirus Type 5 E1A, ADP-ribosylation Factor (ARF-6), Adrenocorticotrophic Hormone, AIF (Apoptosis Inducing Factor), Alkaline Phosphatase (AP), Alpha Fetoprotein (AFP), Alpha Lactalbumin, alpha-1-antichymotrypsin, alpha-1-antitrypsin, Amphiregulin, Amylin Peptide, Amyloid A, Amyloid A4 Protein Precursor, Amyloid Beta (APP), Androgen Receptor, Ang-1, Ang-2, APC, APC11, APC2, Apolipoprotein D, A-Raf, ARC, Ask1/MAPKKK5, ATM, Axonal Growth Cones, b Galactosidase, b-2-Microglobulin, B7-H2, BAG-1, Bak, Bax, B-Cell, B-cell Linker Protein (BLNK), Bcl10/CIPER/CLAP/mE10, bcl-2a, Bcl-6, bcl-X, bcl-XL, Bim (BOD), Biotin, Bonzo/STRL33/TYMSTR, Bovine Serum Albumin, BRCA2 (aa 1323-1346), BrdU, Bromodeoxyuridine (BrdU), CA125, CA19-9, c-Abl, Cadherin (Pan), Cadherin-E, Cadherin-P, Calcitonin, Calcium Pump ATPase, Caldesmon, Calmodulin, Calponin, Calretinin, Casein, Caspase 1, Caspase 2, Caspase 3, Caspase 5, Caspase 6 (Mch 2), Caspase 7 (Mch 3), Caspase 8 (FLICE), Caspase 9, Catenin alpha, Catenin beta, Catenin gamma, Cathepsin D, CCK-8, CD1, CD10, CD100/Leukocyte Semaphorin, CD105, CD106/VCAM, CD115/c-fms/CSF-1R/M-CSFR, CD137 (4-1BB), CD138, CD14, CD15, CD155/PVR (Polio Virus Receptor), CD16, CD165, CD18, CD1a, CD1b, CD2, CD20, CD21, CD23, CD231, CD24, CD25/IL-2 Receptor a, CD26/DPP IV, CD29, CD30 (Reed-Sternberg Cell Marker), CD32/Fcg Receptor II, CD35/CR1, CD36GPIIIb/GPIV, CD3zeta, CD4, CD40, CD42b, CD43, CD45/T200/LCA, CD45RB, CD45RO, CD46, CD5, CD50/ICAM-3, CD53, CD54/ICAM-1, CD56/NCAM-1, CD57, CD59/MACIF/MIRL/Protectin, CD6, CD61/Platelet Glycoprotein IIIA, CD63, CD68, CD71/Transferrin Receptor, CD79a mb-1, CD79b, CD8, CD81/TAPA-1, CD84, CD9, CD94, CD95/Fas, CD98, CDC14A Phosphatase, CDC25C, CDC34, CDC37, CDC47, CDC6, cdh1, Cdk1/p34cdc2, Cdk2, Cdk3, Cdk4, Cdk5, Cdk7, Cdk8, CDw17, CDw60, CDw75, CDw78, CEA/CD66e, c-erbB-2/HER-2/neu Ab-1 (21N), c-erbB-4/HER-4, c-fos, Chk1, Chorionic Gonadotropin beta (hCG-beta), Chromogranin A, CIDE-A, CIDE-B, CITED1, c-jun, Clathrin, claudin 11, Claudin 2, Claudin 3, Claudin 4, Claudin 5, CLAUDIN 7, Claudin-1, CNPase, Collagen II, Collagen IV, Collagen IX, Collagen VII, Connexin 43, COX2, CREB, CREB-Binding Protein, *Cryptococcus neoformans*, c-Src, Cullin-1 (CUL-1), Cullin-2 (CUL-2), Cullin-3 (CUL-3), CXCR4/Fusin, Cyclin B1, Cyclin C, Cyclin D1, Cyclin D3, Cyclin E, Cyclin E2, Cystic Fibrosis Transmembrane Regulator, Cytochrome c, D4-GDI, Daxx, DcR1, DcR2/TRAIL-R4/TRUNDD, Desmin, DFF40 (DNA Fragmentation Factor 40)/CAD, DFF45/ICAD, DJ-1, DNA Ligase I, DNA Polymerase Beta, DNA Polymerase Gamma, DNA Primase (p49), DNA Primase (p58), DNA-PKcs, DP-2, DR3, DR5, Dysferlin, Dystrophin, E2F-1, E2F-2, E2F-3, E2F-4, E2F-5, E3-binding protein (ARM1), EGFR, EMA/CA15-3/MUC-1, Endostatin, Epithelial Membrane Antigen (EMA/CA15-3/MUC-1), Epithelial Specific Antigen, ER beta, ER Ca+2 ATPase2, ERCC1, Erk1, ERK2, Estradiol, Estriol, Estrogen Receptor, Exo1, Ezrin/p81/80K/Cytovillin, F.VIII/VWF, Factor VIII Related Antigen, FADD |

TABLE 4-continued

Illustrative Biomarkers

| Illustrative Class | Biomarkers |
|---|---|
| | (FAS-Associated death domain-containing protein), Fascin, Fas-ligand, Ferritin, FGF-1, FGF-2, FHIT, Fibrillin-1, Fibronectin, Filaggrin, Filamin, FITC, Fli-1, FLIP, Flk-1/KDR/ VEGFR2, Flt-1/VEGFR1, Flt-4, Fra2, FSH, FSH-b, Fyn, Ga0, Gab-1, GABA a Receptor 1, GAD65, Gai1, Gamma Glutamyl Transferase (gGT), Gamma Glutamylcysteine Synthetase(GCS)/Glutamate-cysteine Ligase, GAPDH, Gastrin 1, GCDFP-15, G-CSF, GFAP, Glicentin, Glucagon, Glucose-Regulated Protein 94, GluR 2/3, GluR1, GluR4, GluR6/7, GLUT-1, GLUT-3, Glycogen Synthase Kinase 3b (GSK3b), Glycophorin A, GM-CSF, GnRH Receptor, Golgi Complex, Granulocyte, Granzyme B, Grb2, Green Fluorescent Protein (GFP), GRIP1, Growth Hormone (hGH), GSK-3, GST, GSTmu, *H. Pylori*, HDAC1, HDJ-2/DNAJ, Heat Shock Factor 1, Heat Shock Factor 2, Heat Shock Protein 27/hsp27, Heat Shock Protein 60/hsp60, Heat Shock Protein 70/hsp70, Heat Shock Protein 75/hsp75, Heat Shock Protein 90a/hsp86, Heat Shock Protein 90b/hsp84, *Helicobacter pylori*, Heparan Sulfate Proteoglycan, Hepatic Nuclear Factor-3B, Hepatocyte, Hepatocyte Factor Homologue-4, Hepatocyte Growth Factor, Heregulin, HIF-1a, Histone H1, hPL, HPV 16, HPV 16-E7, HRP, Human Sodium Iodide Symporter (hNIS), I-FLICE/CASPER, IFN gamma, IgA, IGF-1R, IGF-I, IgG, IgM (m-Heavy Chain), I-Kappa-B Kinase b (IKKb), IL-1 alpha, IL-1 beta, IL-10, IL-10R, IL17, IL-2, IL-3, IL-30, IL-4, IL-5, IL-6, IL-8, Inhibin alpha, Insulin, Insulin Receptor, Insulin Receptor Substrate-1, Int-2 Oncoprotein, Integrin beta5, Interferon-a(II), Interferon-g, Involucrin, IP10/CRG2, IPO-38 Proliferation Marker, IRAK, ITK, JNK Activating kinase (JKK1), Kappa Light Chain, Keratin 10, Keratin 10/13, Keratin 14, Keratin 15, Keratin 16, Keratin 18, Keratin 19, Keratin 20, Keratin 5/6/18, Keratin 5/8, Keratin 8, Keratin 8 (phospho-specific Ser73), Keratin 8/18, Keratin (LMW), Keratin (Multi), Keratin (Pan), Ki67, Ku (p70/p80), Ku (p80), L1 Cell Adhesion Molecule, Lambda Light Chain, Laminin B1/b1, Laminin B2/g1, Laminin Receptor, Laminin-s, Lck, Lck (p56lck), Leukotriene (C4, D4, E4), LewisA, LewisB, LH, L-Plastin, LRP/MVP, Luciferase, Macrophage, MADD, MAGE-1, Maltose Binding Protein, MAP1B, MAP2a, b, MART-1/Melan-A, Mast Cell Chymase, Mcl-1, MCM2, MCM5, MDM2, Medroxyprogesterone Acetate (MPA), Mek1, Mek2, Mek6, Mekk-1, Melanoma (gp100), mGluR1, mGluR5, MGMT, MHC I (HLA25 and HLA-Aw32), MHC I (HLA-A), MHC I (HLA-A, B, C), MHC I (HLA-B), MHC II (HLA-DP and DR), MHC II (HLA-DP), MHC II (HLA-DQ), MHC II (HLA-DR), MHC II (HLA-DR) Ia, Microphthalmia, Milk Fat Globule Membrane Protein, Mitochondria, MLH1, MMP-1 (Collagenase-I), MMP-10 (Stromilysin-2), MMP-11 (Stromelysin-3), MMP-13 (Collagenase-3), MMP-14/MT1-MMP, MMP-15/MT2-MMP, MMP-16/MT3-MMP, MMP-19, MMP-2 (72 kDa Collagenase IV), MMP-23, MMP-7 (Matrilysin), MMP-9 (92 kDa Collagenase IV), Moesin, mRANKL, Muc-1, Mucin 2, Mucin 3 (MUC3), Mucin 5AC, MyD88, Myelin/Oligodendrocyte, Myeloid Specific Marker, Myeloperoxidase, MyoD1, Myogenin, Myoglobin, Myosin Smooth Muscle Heavy Chain, Nck, Negative Control for Mouse IgG1, Negative Control for Mouse IgG2a, Negative Control for Mouse IgG3, Negative Control for Mouse IgM, Negative Control for Rabbit IgG, Neurofilament, Neurofilament (160 kDa), Neurofilament (200 kDa), Neurofilament (68 kDa), Neuron Specific Enolase, Neutrophil Elastase, NF kappa B/p50, NF kappa B/p65 (Rel A), NGF-Receptor (p75NGFR), brain Nitric Oxide Synthase (bNOS), endothelial Nitric Oxide Synthase (eNOS), nm23, NOS-i, NOS-u, Notch, Nucleophosmin (NPM), NuMA, O ct-1, Oct-2/, Oct-3/, Ornithine Decarboxylase, Osteopontin, p130, p130cas, p14ARF, p15INK4b, p16INK4a, p170, p170/MDR-1, p18INK4c, p19ARF, p19Skp1, p21WAF1, p27Kip1, p300/ CBP, p35nck5a, P504S, p53, p57Kip2 Ab-7, p63 (p53 Family Member), p73, p73a, p73a/b, p95VAV, Parathyroid Hormone, Parathyroid Hormone Receptor Type 1, Parkin, PARP, PARP (Poly ADP-Ribose Polymerase), Pax-5, Paxillin, PCNA, PCTAIRE2, PDGF, PDGFR alpha, PDGFR beta, Pds1, Perform, PGP9.5, PHAS-I, PHAS-II, Phospho-Ser/Thr/Tyr, Phosphotyrosine, PLAP, Plasma Cell Marker, Plasminogen, PLC gamma 1, PMP-22, *Pneumocystis jiroveci*, PPAR-gamma, PR3 (Proteinase 3), Presenillin, Progesterone, Progesterone Receptor, Progesterone Receptor (phospho-specific) - Serine 190, Progesterone Receptor (phospho-specific) - Serine 294, Prohibitin, Prolactin, Prolactin Receptor, Prostate Apoptosis Response Protein-4, Prostate Specific Acid Phosphatase, Prostate Specific Antigen, pS2, PSCA, Rabies Virus, RAD1, Rad51, Raf1, Raf-1 (Phospho-specific), RAIDD, Ras, Rad18, Renal Cell Carcinoma, Ret Oncoprotein, Retinoblastoma, Retinoblastoma (Rb) (Phospho-specific Serine608), Retinoic Acid Receptor (b), Retinoid X Receptor (hRXR), Retinol Binding Protein, Rhodopsin (Opsin), ROC, RPA/p32, RPA/p70, Ruv A, Ruv B, Ruv C, S100, S100A4, S100A6, SHP-1, SIM Ag (SIMA-4D3), SIRP a1, sm, SODD (Silencer of Death Domain), Somatostatin Receptor-I, SRC1 (Steroid Receptor Coactivator-1) Ab-1, SREBP-1 (Sterol Regulatory Element Binding Protein-1), SRF (Serum Response Factor), Stat-1, Stat3, Stat5, Stat5a, Stat5b, Stat6, Streptavidin, Superoxide Dismutase, Surfactant Protein A, Surfactant Protein B, Surfactant Protein B (Pro), Survivin, SV40 Large T Antigen, Syk, Synaptophysin, Synuclein, Synuclein beta, Synuclein pan, TACE (TNF-alpha converting enzyme)/ADAM17, TAG-72, tau, TdT, Tenascin, Testosterone, TGF beta 3, TGF-beta 2, Thomsen-Friedenreich Antigen, Thrombospondin, Thymidine Phosphorylase, Thymidylate Synthase, Thymine Glycols, Thyroglobulin, Thyroid Hormone Receptor beta, Thyroid Hormone Receptor, Thyroid Stimulating Hormone (TSH), TID-1, TIMP-1, TIMP-2, TNF alpha, TNFa, TNR-R2, Topo II beta, Topoisomerase IIa, Toxoplasma Gondii, TR2, TRADD, Transforming Growth Factor a, Transglutaminase II, TRAP, Tropomyosin, TRP75/ gp75, TrxR2, TTF-1, Tubulin, Tubulin-a, Tubulin-b, Tyrosinase, Ubiquitin, UCP3, uPA, Urocortin, Vacular Endothelial Growth Factor(VEGF), Vimentin, Vinculin, Vitamin D Receptor (VDR), von Hippel-Lindau Protein, Wnt-1, Xanthine Oxidase, XPA, XPF, XPG, XRCC1, XRCC2, ZAP-70, Zip kinase |
| Known Cancer Genes | ABL1, ABL2, ACSL3, AF15Q14, AF1Q, AF3p21, AF5q31, AKAP9, AKT1, AKT2, ALDH2, ALK, ALO17, APC, ARHGEF12, ARHH, ARID1A, ARID2, ARNT, ASPSCR1, |

TABLE 4-continued

Illustrative Biomarkers

| Illustrative Class | Biomarkers |
|---|---|
| | ASXL1, ATF1, ATIC, ATM, ATRX, BAP1, BCL10, BCL11A, BCL11B, BCL2, BCL3, BCL5, BCL6, BCL7A, BCL9, BCOR, BCR, BHD, BIRC3, BLM, BMPR1A, BRAF, BRCA1, BRCA2, BRD3, BRD4, BRIP1, BTG1, BUB1B, C12orf9, C15orf21, C15orf55, C16orf75, CANT1, CARD11, CARS, CBFA2T1, CBFA2T3, CBFB, CBL, CBLB, CBLC, CCNB1IP1, CCND1, CCND2, CCND3, CCNE1, CD273, CD274, CD74, CD79A, CD79B, CDH1, CDH11, CDK12, CDK4, CDK6, CDKN2A, CDKN2a(p14), CDKN2C, CDX2, CEBPA, CEP1, CHCHD7, CHEK2, CHIC2, CHN1, CIC, CIITA, CLTC, CLTCL1, CMKOR1, COL1A1, COPEB, COX6C, CREB1, CREB3L1, CREB3L2, CREBBP, CRLF2, CRTC3, CTNNB1, CYLD, D10S170, DAXX, DDB2, DDIT3, DDX10, DDX5, DDX6, DEK, DICER1, DNMT3A, DUX4, EBF1, EGFR, EIF4A2, ELF4, ELK4, ELKS, ELL, ELN, EML4, EP300, EPS15, ERBB2, ERCC2, ERCC3, ERCC4, ERCC5, ERG, ETV1, ETV4, ETV5, ETV6, EVI1, EWSR1, EXT1, EXT2, EZH2, FACL6, FAM22A, FAM22B, FAM46C, FANCA, FANCC, FANCD2, FANCE, FANCF, FANCG, FBXO11, FBXW7, FCGR2B, FEV, FGFR1, FGFR1OP, FGFR2, FGFR3, FH, FHIT, FIP1L1, FLI1, FLJ27352, FLT3, FNBP1, FOXL2, FOXO1A, FOXO3A, FOXP1, FSTL3, FUBP1, FUS, FVT1, GAS7, GATA1, GATA2, GATA3, GMPS, GNA11, GNAQ, GNAS, GOLGA5, GOPC, GPC3, GPHN, GRAF, HCMOGT-1, HEAB, HERPUD1, HEY1, HIP1, HIST1H4I, HLF, HLXB9, HMGA1, HMGA2, HNRNPA2B1, HOOK3, HOXA11, HOXA13, HOXA9, HOXC11, HOXC13, HOXD11, HOXD13, HRAS, HRPT2, HSPCA, HSPCB, IDH1, IDH2, IGH@, IGK@, IGL@, IKZF1, IL2, IL21R, IL6ST, IL7R, IRF4, IRTA1, ITK, JAK1, JAK2, JAK3, JAZF1, JUN, KDM5A, KDM5C, KDM6A, KDR, KIAA1549, KIT, KLK2, KRAS, KTN1, LAF4, LASP1, LCK, LCP1, LCX, LHFP, LIFR, LMO1, LMO2, LPP, LYL1, MADH4, MAF, MAFB, MALT1, MAML2, MAP2K4, MDM2, MDM4, MDS1, MDS2, MECT1, MED12, MEN1, MET, MITF, MKL1, MLF1, MLH1, MLL, MLL2, MLL3, MLLT1, MLLT10, MLLT2, MLLT3, MLLT4, MLLT6, MLLT7, MN1, MPL, MSF, MSH2, MSH6, MSI2, MSN, MTCP1, MUC1, MUTYH, MYB, MYC, MYCL1, MYCN, MYD88, MYH11, MYH9, MYST4, NACA, NBS1, NCOA1, NCOA2, NCOA4, NDRG1, NF1, NF2, NFE2L2, NFIB, NFKB2, NIN, NKX2-1, NONO, NOTCH1, NOTCH2, NPM1, NR4A3, NRAS, NSD1, NTRK1, NTRK3, NUMA1, NUP214, NUP98, OLIG2, OMD, P2RY8, PAFAH1B2, PALB2, PAX3, PAX5, PAX7, PAX8, PBRM1, PBX1, PCM1, PCSK7, PDE4DIP, PDGFB, PDGFRA, PDGFRB, PER1, PHOX2B, PICALM, PIK3CA, PIK3R1, PIM1, PLAG1, PML, PMS1, PMS2, PMX1, PNUTL1, POU2AF1, POU5F1, PPARG, PPP2R1A, PRCC, PRDM1, PRDM16, PRF1, PRKAR1A, PRO1073, PSIP2, PTCH, PTEN, PTPN11, RAB5EP, RAD51L1, RAF1, RALGDS, RANBP17, RAP1GDS1, RARA, RB1, RBM15, RECQL4, REL, RET, ROS1, RPL22, RPN1, RUNDC2A, RUNX1, RUNXBP2, SBDS, SDH5, SDHB, SDHC, SDHD, SEPT6, SET, SETD2, SF3B1, SFPQ, SFRS3, SH3GL1, SIL, SLC45A3, SMARCA4, SMARCB1, SMO, SOCS1, SOX2, SRGAP3, SRSF2, SS18, SS18L1, SSH3BP1, SSX1, SSX2, SSX4, STK11, STL, SUFU, SUZ12, SYK, TAF15, TAL1, TAL2, TCEA1, TCF1, TCF12, TCF3, TCF7L2, TCL1A, TCL6, TET2, TFE3, TFEB, TFG, TFPT, TFRC, THRAP3, TIF1, TLX1, TLX3, TMPRSS2, TNFAIP3, TNFRSF14, TNFRSF17, TNFRSF6, TOP1, TP53, TPM3, TPM4, TPR, TRA@, TRB@, TRD@, TRIM27, TRIM33, TRIP11, TSC1, TSC2, TSHR, TTL, U2AF1, USP6, VHL, VTI1A, WAS, WHSC1, WHSC1L1, WIF1, WRN, WT1, WTX, XPA, XPC, XPO1, YWHAE, ZNF145, ZNF198, ZNF278, ZNF331, ZNF384, ZNF521, ZNF9, ZRSR2 |
| Known Cancer Genes | AR, androgen receptor; ARPC1A, actin-related protein complex 2/3 subunit A; AURKA, Aurora kinase A; BAG4, BCl-2 associated anthogene 4; BCl2l2, BCl-2 like 2; BIRC2, Baculovirus IAP repeat containing protein 2; CACNA1E, calcium channel voltage dependent alpha-1E subunit; CCNE1, cyclin E1; CDK4, cyclin dependent kinase 4; CHD1L, chromodomain helicase DNA binding domain 1-like; CKS1B, CDC28 protein kinase 1B; COPS3, COP9 subunit 3; DCUN1D1, DCN1 domain containing protein 1; DYRK2, dual specificity tyrosine phosphorylation regulated kinase 2; EEF1A2, eukaryotic elongation transcription factor 1 alpha 2; EGFR, epidermal growth factor receptor; FADD, Fas-associated via death domain; FGFR1, fibroblast growth factor receptor 1, GATA6, GATA binding protein 6; GPC5, glypican 5; GRB7, growth factor receptor bound protein 7; MAP3K5, mitogen activated protein kinase kinase kinase 5; MED29, mediator complex subunit 5; MITF, microphthalmia associated transcription factor; MTDH, metadherin; NCOA3, nuclear receptor coactivator 3; NKX2-1, NK2 homeobox 1; PAK1, p21/CDC42/RAC1-activated kinase 1; PAX9, paired box gene 9; PIK3CA, phosphatidylinositol-3 kinase catalytic a; PLA2G10, phopholipase A2, group X; PPM1D, protein phosphatase magnesium-dependent 1D; PTK6, protein tyrosine kinase 6; PRKCI, protein kinase C iota; RPS6KB1, ribosomal protein s6 kinase 70 kDa; SKP2, s-phase kinase associated protein; SMURF1, sMAD specific E3 ubiquitin protein ligase 1; SHH, sonic hedgehog homologue; STARD3, sTAR-related lipid transfer domain containing protein 3; YWHAQ, tyrosine 3-monooxygenase/tryptophan 5-monooxygenase activation protein, zeta isoform; ZNF217, zinc finger protein 217 |
| Mitotic Related Cancer Genes | Aurora kinase A (AURKA); Aurora kinase B (AURKB); Baculoviral IAP repeat-containing 5, survivin (BIRC5); Budding uninhibited by benzimidazoles 1 homolog (BUB1); Budding uninhibited by benzimidazoles 1 homolog beta, BUBR1 (BUB1B); Budding uninhibited by benzimidazoles 3 homolog (BUB3); CDC28 protein kinase regulatory subunit 1B (CKS1B); CDC28 protein kinase regulatory subunit 2 (CKS2); Cell division cycle 2 (CDC2)/CDK1 Cell division cycle 20 homolog (CDC20); Cell division cycle-associated 8, borealin (CDCA8); Centromere protein F, mitosin (CENPF); Centrosomal protein 110 kDa (CEP110); Checkpoint with forkhead and ring finger domains (CHFR); Cyclin B1 (CCNB1); Cyclin B2 (CCNB2); Cytoskeleton-associated protein 5 (CKAP5/ch-TOG); Microtubule-associated protein RP/EB family member 1. End-binding protein 1, EB1 (MAPRE1); Epithelial cell transforming sequence 2 oncogene (ECT2); Extra spindle poles like 1, separase (ESPL1); |

TABLE 4-continued

Illustrative Biomarkers

| Illustrative Class | Biomarkers |
|---|---|
| | Forkhead box M1 (FOXM1); H2A histone family, member X (H2AFX); Kinesin family member 4A (KIF4A); Kinetochore-associated 1 (KNTC1/ROD); Kinetochore-associated 2; highly expressed in cancer 1 (KNTC2/HEC1); Large tumor suppressor, homolog 1 (LATS1); Large tumor suppressor, homolog 2 (LATS2); Mitotic arrest deficient-like 1; MAD1 (MAD1L1); Mitotic arrest deficient-like 2; MAD2 (MAD2L1); Mps1 protein kinase (TTK); Never in mitosis gene a-related kinase 2 (NEK2); Ninein, GSKSb interacting protein (NIN); Non-SMC condensin I complex, subunit D2 (NCAPD2/CNAP1); Non-SMC condensin I complex, subunit H (NACPH/CAPH); Nuclear mitotic apparatus protein 1 (NUMA1); Nucleophosmin (nucleolar phosphoprotein B23, numatrin); (NPM1); Nucleoporin (NUP98); Pericentriolar material 1 (PCM1); Pituitary tumor-transforming 1, securin (PTTG1); Polo-like kinase 1 (PLK1); Polo-like kinase 4 (PLK4/SAK); Protein (peptidylprolyl cis/trans isomerase) NIMA-interacting 1 (PIN1); Protein regulator of cytokinesis 1 (PRC1); RAD21 homolog (RAD21); Ras association (RalGDS/AF-6); domain family 1 (RASSF1); Stromal antigen 1 (STAG1); Synuclein-c, breast cancer-specific protein 1 (SNCG, BCSG1); Targeting protein for Xklp2 (TPX2); Transforming, acidic coiled-coil containing protein 3 (TACC3); Ubiquitin-conjugating enzyme E2C (UBE2C); Ubiquitin-conjugating enzyme E2I (UBE2I/UBC9); ZW10 interactor, (ZWINT); ZW10, kinetochore-associated homolog (ZW10); Zwilch, kinetochore-associated homolog (ZWILCH) |
| Ribonucleoprotein complexes | Argonaute family member, Ago1, Ago2, Ago3, Ago4, GW182 (TNRC6A), TNRC6B, TNRC6C, HNRNPA2B1, HNRPAB, ILF2, NCL (Nucleolin), NPM1 (Nucleophosmin), RPL10A, RPL5, RPLP1, RPS12, RPS19, SNRPG, TROVE2, apolipoprotein, apolipoprotein A, apo A-I, apo A-II, apo A-IV, apo A-V, apolipoprotein B, apo B48, apo B100, apolipoprotein C, apo C-I, apo C-II, apo C-III, apo C-IV, apolipoprotein D (ApoD), apolipoprotein E (ApoE), apolipoprotein H (ApoH), apolipoprotein L, APOL1, APOL2, APOL3, APOL4, APOL5, APOL6, APOLD1 |
| Cytokine Receptors | 4-1BB, ALCAM, B7-1, BCMA, CD14, CD30, CD40 Ligand, CEACAM-1, DR6, Dtk, Endoglin, ErbB3, E-Selectin, Fas, Flt-3L, GITR, HVEM, ICAM-3, IL-1 R4, IL-1 RI, IL-10 Rbeta, IL-17R, IL-2Rgamma, IL-21R, LIMPII, Lipocalin-2, L-Selectin, LYVE-1, MICA, MICB, NRG1-beta1, PDGF Rbeta, PECAM-1, RAGE, TIM-1, TRAIL R3, Trappin-2, uPAR, VCAM-1, XEDAR |
| Prostate and colorectal cancer vesicles | ErbB3, RAGE, Trail R3 |
| Colorectal cancer vesicles | IL-1 alpha, CA125, Filamin, Amyloid A |
| Colorectal cancer v adenoma vesicles | Involucrin, CD57, Prohibitin, Thrombospondin, Laminin B1/b1, Filamin, 14.3.3 gamma, 14.3.3 Pan |
| Colorectal adenoma vesicles | Involucrin, Prohibitin, Laminin B1/b1, IL-3, Filamin, 14.3.3 gamma, 14.3.3 Pan, MMP-15/ MT2-MMP, hPL, Ubiquitin, and mRANKL |
| Brain cancer vesicles | Prohibitin, CD57, Filamin, CD18, b-2-Microglobulin, IL-2, IL-3, CD16, p170, Keratin 19, Pds1, Glicentin, SRF (Serum Response Factor), E3-binding protein (ARM1), Collagen II, SRC1 (Steroid Receptor Coactivator-1) Ab-1, Caldesmon, GFAP, TRP75/gp75, alpha-1-antichymotrypsin, Hepatic Nuclear Factor-3B, FLAP, Tyrosinase, NF kappa B/p50, Melanoma (gp100), Cyclin E, 6-Histidine, Mucin 3 (MUC3), TdT, CD21, XPA, Superoxide Dismutase, Glycogen Synthase Kinase 3b (GSK3b), CD54/ICAM-1, Thrombospondin, Gail, CD79a mb-1, IL-1 beta, Cytochrome c, RAD1, bcl-X, CD50/ICAM-3, Neurofilament, Alkaline Phosphatase (AP), ER Ca+2 ATPase2, PCNA, F.VIII/VWF, SV40 Large T Antigen, Paxillin, Fascin, CD165, GRIP1, Cdk8, Nucleophosmin (NPM), alpha-1-antitrypsin, CD32/Fcg Receptor II, Keratin 8 (phospho-specific Ser73), DR5, CD46, TID-1, MHC II (HLA-DQ), Plasma Cell Marker, DR3, Calmodulin, AIF (Apoptosis Inducing Factor), DNA Polymerase Beta, Vitamin D Receptor (VDR), Bcl10/CIPER/CLAP/mE10, Neuron Specific Enolase, CXCR4/Fusin, Neurofilament (68 kDa), PDGFR, beta, Growth Hormone (hGH), Mast Cell Chymase, Ret Oncoprotein, and Phosphotyrosine |
| Melanoma vesicles | Caspase 5, Thrombospondin, Filamin, Ferritin, 14.3.3 gamma, 14.3.3 Pan, CD71/Transferrin Receptor, and Prostate Apoptosis Response Protein-4 |
| Head and neck cancer vesicles | 14.3.3 Pan, Filamin, 14.3.3 gamma, CD71/Transferrin Receptor, CD30, Cdk5, CD138, Thymidine Phosphorylase, Ruv 5, Thrombospondin, CD1, Von Hippel-Lindau Protein, CD46, Rad51, Ferritin, c-Abl, Actin, Muscle Specific, LewisB |
| Membrane proteins | carbonic anhydrase IX, B7, CCCL19, CCCL21, CSAp, HER-2/neu, BrE3, CD1, CD1a, CD2, CD3, CD4, CD5, CD8, CD11A, CD14, CD15, CD16, CD18, CD19, CD20, CD21, CD22, CD23, CD25, CD29, CD30, CD32b, CD33, CD37, CD38, CD40, CD40L, CD44, CD45, CD46, CD52, CD54, CD55, CD59, CD64, CD67, CD70, CD74, CD79a, CD80, CD83, CD95, CD126, CD133, CD138, CD147, CD154, CEACAM5, CEACAM-6, alpha-fetoprotein (AFP), VEGF, ED-B fibronectin, EGP-1, EGP-2, EOF receptor (ErbB1), ErbB2, ErbB3, Factor H, FHL-1, Flt-3, folate receptor, Ga 733,GROB, HMGB-1, hypoxia inducible factor (HIF), HM1.24, HER-2/neu, insulin-like growth factor (ILGF), IFN-γ, IFN-α, IL-β, IL-2R, IL-4R, IL-6R, IL-13R, IL-15R, IL-17R, IL-18R, IL-2, IL-6, IL-8, IL-12, IL-15, IL-17, IL-18, IL-25, IP-10, IGF-1R, Ia, HM1.24, gangliosides, HCG, HLA-DR, CD66a-d, MAGE, mCRP, MCP-1, MIP-1A, MIP-1B, macrophage migration-inhibitory factor (MIF), MUC1, MUC2, MUC3, MUC4, MUC5, placental growth factor (P1GF), PSA (prostate-specific antigen), PSMA, PSMA dimer, PAM4 antigen, NCA-95, NCA-90, A3, A33, Ep-CAM, KS-1, Le(y), mesothelin, S100, tenascin, TAC, Tn antigen, Thomas-Friedenreich antigens, tumor necrosis antigens, tumor angiogenesis antigens, TNF-α, TRAIL receptor (R1 and R2), VEGFR, RANTES, T101, cancer stem cell antigens, complement factors C3, C3a, C3b, C5a, C5 |
| Cluster of Differentiation | CD1, CD2, CD3, CD4, CD5, CD6, CD7, CD8, CD9, CD10, CD11a, CD11b, CD11c, CD12w, CD13, CD14, CD15, CD16, CDw17, CD18, CD19, CD20, CD21, CD22, CD23, |

TABLE 4-continued

Illustrative Biomarkers

| Illustrative Class | Biomarkers |
| --- | --- |
| (CD) proteins | CD24, CD25, CD26, CD27, CD28, CD29, CD30, CD31, CD32, CD33, CD34, CD35, CD36, CD37, CD38, CD39, CD40, CD41, CD42, CD43, CD44, CD45, CD46, CD47, CD48, CD49a, CD49b, CD49c, CD49d, CD49e, CD49f, CD53, CD54, CD55, CD56, CD57, CD58, CD59, CD61, CD62E, CD62L, CD62P, CD63, CD68, CD69, CD71, CD72, CD73, CD74, CD80, CD81, CD82, CD83, CD86, CD87, CD88, CD89, CD90, CD91, CD95, CD96, CD100, CD103, CD105, CD106, CD107, CD107a, CD107b, CD109, CD117, CD120, CD127, CD133, CD134, CD135, CD138, CD141, CD142, CD143, CD144, CD147, CD151, CD152, CD154, CD156, CD158, CD163, CD165, CD166, CD168, CD184, CDw186, CD195, CD197, CD209, CD202a, CD220, CD221, CD235a, CD271, CD303, CD304, CD309, CD326 |
| Interleukin (IL) proteins | IL-1, IL-2, IL-3, IL-4, IL-5, IL-6, IL-7, IL-8 or CXCL8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IL-35, IL-36 |
| IL receptors | CD121a/IL1R1, CD121b/IL1R2, CD25/IL2RA, CD122/IL2RB, CD132/IL2RG, CD123/IL3RA, CD131/IL3RB, CD124/IL4R, CD132/IL2RG, CD125/IL5RA, CD131/IL3RB, CD126/IL6RA, CD130/IR6RB, CD127/IL7RA, CD132/IL2RG, CXCR1/IL8RA, CXCR2/IL8RB/CD128, CD129/IL9R, CD210/IL10RA, CDW210B/IL10RB, IL11RA, CD212/IL12RB1, IR12RB2, IL13R, IL15RA, CD4, CDw217/IL17RA, IL17RB, CDw218a/IL18R1, IL20R, IL20R, IL21R, IL22R, IL23R, IL20R, LY6E, IL20R1, IL27RA, IL28R, IL31RA |
| Mucin (MUC) proteins | MUC1, MUC2, MUC3A, MUC3B, MUC4, MUC5AC, MUC5B, MUC6, MUC7, MUC8, MUC12, MUC13, MUC15, MUC16, MUC17, MUC19, and MUC20 |
| MUC1 isoforms | mucin-1 isoform 2 precursor or mature form (NP_001018016.1), mucin-1 isoform 3 precursor or mature form (NP_001018017.1), mucin-1 isoform 5 precursor or mature form (NP_001037855.1), mucin-1 isoform 6 precursor or mature form (NP_001037856.1), mucin-1 isoform 7 precursor or mature form (NP_001037857.1), mucin-1 isoform 8 precursor or mature form (NP_001037858.1), mucin-1 isoform 9 precursor or mature form (NP_001191214.1), mucin-1 isoform 10 precursor or mature form (NP_001191215.1), mucin-1 isoform 11 precursor or mature form (NP_001191216.1), mucin-1 isoform 12 precursor or mature form (NP_001191217.1), mucin-1 isoform 13 precursor or mature form (NP_001191218.1), mucin-1 isoform 14 precursor or mature form (NP_001191219.1), mucin-1 isoform 15 precursor or mature form (NP_001191200.1), mucin-1 isoform 16 precursor or mature form (NP_001191201.1), mucin-1 isoform 17 precursor or mature form (NP_001191202.1), mucin-1 isoform 18 precursor or mature form (NP_001191203.1), mucin-1 isoform 19 precursor or mature form (NP_001191204.1), mucin-1 isoform 20 precursor or mature form (NP_001191205.1), mucin-1 isoform 21 precursor or mature form (NP_001191206.1), mucin-1 isoform 1 precursor or mature form (NP_002447.4), ENSP00000357380, ENSP00000357377, ENSP00000389098, ENSP00000357374, ENSP00000357381, ENSP00000339690, ENSP00000342814, ENSP00000357383, ENSP00000357375, ENSP00000338983, ENSP00000343482, ENSP00000406633, ENSP00000388172, ENSP00000357378, P15941-1, P15941-2, P15941-3, P15941-4, P15941-5, P15941-6, P15941-7, P15941-8, P15941-9, P15941-10, secreted isoform, membrane bound isoform, CA 27.29 (BR 27.29), CA 15-3, PAM4 reactive antigen, underglycosylated isoform, unglycosylated isoform, CanAg antigen |
| MUC1 interacting proteins | ABL1, SRC, CTNND1, ERBB2, GSK3B, JUP, PRKCD, APC, GALNT1, GALNT10, GALNT12, JUN, LCK, OSGEP, ZAP70, CTNNB1, EGFR, SOS1, ERBB3, ERBB4, GRB2, ESR1, GALNT2, GALNT4, LYN, TP53, C1GALT1, C1GALT1C1, GALNT3, GALNT6, GCNT1, GCNT4, MUC12, MUC13, MUC15, MUC17, MUC19, MUC2, MUC20, MUC3A, MUC4, MUC5B, MUC6, MUC7, MUCL1, ST3GAL1, ST3GAL3, ST3GAL4, ST6GALNAC2, B3GNT2, B3GNT3, B3GNT4, B3GNT5, B3GNT7, B4GALT5, GALNT11, GALNT13, GALNT14, GALNT5, GALNT8, GALNT9, ST3GAL2, ST6GAL1, ST6GALNAC4, GALNT15, MYOD1, SIGLEC1, IKBKB, TNFRSF1A, IKBKG, MUC1 |
| Tumor markers | Alphafetoprotein (AFP), Carcinoembryonic antigen (CEA), CA-125, MUC-1, Epithelial tumor antigen (ETA), Tyrosinase, Melanoma-associated antigen (MAGE), p53 |
| Tumor markers | Alpha fetoprotein (AFP), CA15-3, CA27-29, CA19-9, CA-125, Calretinin, Carcinoembryonic antigen, CD34, CD99, CD117, Chromogranin, Cytokeratin (various types), Desmin, Epithelial membrane protein (EMA), Factor VIII, CD31 FL1, Glial fibrillary acidic protein (GFAP), Gross cystic disease fluid protein (GCDFP-15), HMB-45, Human chorionic gonadotropin (hCG), immunoglobulin, inhibin, keratin (various types), PTPRC (CD45), lymphocyte marker (various types, MART-1 (Melan-A), Myo D1, muscle-specific actin (MSA), neurofilament, neuron-specific enolase (NSE), placental alkaline phosphatase (PLAP), prostate-specific antigen, S100 protein, smooth muscle actin (SMA), synaptophysin, thyroglobulin, thyroid transcription factor-1, Tumor M2-PK, vimentin |
| Cell adhesion molecule (CAMs) | Immunoglobulin superfamily CAMs (IgSF CAMs), N-CAM (Myelin protein zero), ICAM (1, 5), VCAM-1, PE-CAM, L1-CAM, Nectin (PVRL1, PVRL2, PVRL3), Integrins, LFA-1 (CD11a + CD18), Integrin alphaXbeta2 (CD11c + CD18), Macrophage-1 antigen (CD11b + CD18), VLA-4 (CD49d + CD29), Glycoprotein IIb/IIIa (ITGA2B + ITGB3), Cadherins, CDH1, CDH2, CDH3, Desmosomal, Desmoglein (DSG1, DSG2, DSG3, DSG4), Desmocollin (DSC1, DSC2, DSC3), Protocadherin, PCDH1, T-cadherin, CDH4, CDH5, CDH6, CDH8, CDH11, CDH12, CDH15, CDH16, CDH17, CDH9, CDH10, Selectins, E-selectin, L-selectin, P-selectin, Lymphocyte homing receptor: CD44, L-selectin, integrin (VLA-4, LFA-1), Carcinoembryonic antigen (CEA), CD22, CD24, CD44, CD146, CD164 |
| Annexins | ANXA1; ANXA10; ANXA11; ANXA13; ANXA2; ANXA3; ANXA4; ANXA5; ANXA6; ANXA7; ANXA8; ANXA8L1; ANXA8L2; ANXA9 |
| Cadherins ("calcium- | CDH1, CDH2, CDH12, CDH3, Deomoglein, DSG1, DSG2, DSG3, DSG4, Desmocollin, DSC1, DSC2, DSC3, Protocadherins, PCDH1, PCDH10, PCDH11x, PCDH11y, PCDH12, |

TABLE 4-continued

Illustrative Biomarkers

| Illustrative Class | Biomarkers |
|---|---|
| dependent adhesion") | FAT, FAT2, FAT4, PCDH15, PCDH17, PCDH18, PCDH19; PCDH20; PCDH7, PCDH8, PCDH9, PCDHA1, PCDHA10, PCDHA11, PCDHA12, PCDHA13, PCDHA2, PCDHA3, PCDHA4, PCDHA5, PCDHA6, PCDHA7, PCDHA8, PCDHA9, PCDHAC1, PCDHAC2, PCDHB1, PCDHB10, PCDHB11, PCDHB12, PCDHB13, PCDHB14, PCDHB15, PCDHB16, PCDHB17, PCDHB18, PCDHB2, PCDHB3, PCDHB4, PCDHB5, PCDHB6, PCDHB7, PCDHB8, PCDHB9, PCDHGA1, PCDHGA10, PCDHGA11, PCDHGA12, PCDHGA2; PCDHGA3, PCDHGA4, PCDHGA5, PCDHGA6, PCDHGA7, PCDHGA8, PCDHGA9, PCDHGB1, PCDHGB2, PCDHGB3, PCDHGB4, PCDHGB5, PCDHGB6, PCDHGB7, PCDHGC3, PCDHGC4, PCDHGC5, CDH9 (cadherin 9, type 2 (T1-cadherin)), CDH10 (cadherin 10, type 2 (T2-cadherin)), CDH5 (VE-cadherin (vascular endothelial)), CDH6 (K-cadherin (kidney)), CDH7 (cadherin 7, type 2), CDH8 (cadherin 8, type 2), CDH11 (OB-cadherin (osteoblast)), CDH13 (T-cadherin - H-cadherin (heart)), CDH15 (M-cadherin (myotubule)), CDH16 (KSP-cadherin)), CDH17 (LI cadherin (liver-intestine)), CDH18 (cadherin 18, type 2), CDH19 (cadherin 19, type 2), CDH20 (cadherin 20, type 2), CDH23 (cadherin 23, (neurosensory epithelium)), CDH10, CDH11, CDH13, CDH15, CDH16, CDH17, CDH18, CDH19, CDH20, CDH22, CDH23, CDH24, CDH26, CDH28, CDH4, CDH5, CDH6, CDH7, CDH8, CDH9, CELSR1, CELSR2, CELSR3, CLSTN1, CLSTN2, CLSTN3, DCHS1, DCHS2, LOC389118, PCLKC, RESDA1, RET |
| ECAD (CDH1) downregulators | SNAI1/SNAIL, ZFHX1B/SIP1, SNAI2/SLUG, TWIST1, DeltaEF1 |
| ECAD upregulators | AML1, p300, HNF3 |
| ECAD interacting proteins | ACADVL, ACTG1, ACTN1, ACTN4, ACTR3, ADAM10, ADAM9, AJAP1, ANAPC1, ANAPC11, ANAPC4, ANAPC7, ANK2, ANP32B, APC2, ARHGAP32, ARPC2, ARVCF, BOC, C1QBP, CA9, CASP3, CASP8, CAV1, CBLL1, CCNB1, CCND1, CCT6A, CDC16, CDC23, CDC26, CDC27, CDC42, CDH2, CDH3, CDK5R1, CDON, CDR2, CFTR, CREBBP, CSE1L, CSNK2A1, CTNNA1, CTNNB1, CTNND1, CTNND2, DNAJA1, DRG1, EGFR, EP300, ERBB2, ERBB2IP, ERG, EZR, PER, FGFR1, FOXM1, FRMD5, FYN, GBAS, GNA12, GNA13, GNB2L1, GSK3B, HDAC1, HDAC2, HSP90AA1, HSPA1A, HSPA1B, HSPD1, IGHA1, IQGAP1, IRS1, ITGAE, ITGB7, JUP, KIFC3, KLRG1, KRT1, KRT9, LIMA1, LMNA, MAD2L2, MAGI1, MAK, MDM2, MET, MYO6, MYO7A, NDRG1, NEDD9, NIPSNAP1, NKD2, PHLPP1, PIP5K1C, PKD1, PKP4, PLEKHA7, POLR2E, PPP1CA, PRKD1, PSEN1, PTPN1, PTPN14, PTPRF, PTPRM, PTPRQ, PTTG1, PVR, PVRL1, RAB8B, RRM2, SCRIB, SET, SIX1, SKI, SKP2, SRC, TACC3, TAS2R13, TGM2, TJP1, TK1, TNS3, TTK, UBC, USP9X, VCL, VEZT, XRCC5, YAP1, YES1, ZC3HC1 |
| Epithelial-mesenchymal transition (EMT) | SERPINA3, ACTN1, AGR2, AKAP12, ALCAM, AP1M2, AXL, BSPRY, CCL2, CDH1, CDH2, CEP170, CLDN3, CLDN4, CNN3, CYP4X1, DNMT3A, DSG3, DSP, EFNB2, EHF, ELF3, ELF5, ERBB3, ETV5, FLRT3, FOSB, FOSL1, FOXC1, FX YD 5, GPDIL, HMGA1, HMGA2, HOPX, IFI16, IGFBP2, IHH, IKBIP, IL-11, IL-18, IL6, IL8, ITGA5, ITGB3, LAMB1, LCN2, MAP7, MB, MMP7, MMP9, MPZL2, MSLN, MTA3, MTSS1, OCLN, PCOLCE2, PECAM1, PLAUR, PLXNB1, PPL, PPP1R9A, RASSF8, SCNN1A, SERPINB2, SERPINE1, SFRP1, SH3YL1, SLC27A2, SMAD7, SNAI1, SNAI2, SPARC, SPDEF, SRPX, STAT5A, TBX2, TJP3, TMEM125, TMEM45B, TWIST1, VCAN, VIM, VWF, XBP1, YBX1, ZBTB10, ZEB1, ZEB2 |
| Vesicle Associated | ALB, C3, A2M, TF, APOB, KRT1, KRT10, FGA, IGHG1, SERPINA1, FOB, KRT2, HP, IGHG3, IGHA1, SERPINA3, C4A, IGKC, C4B, CP, IGHM, FGG, KRT9, IGHG2, FN1, CFH, SERPINC1, C4A, APOA1, GC, Ig mu heavy chain disease protein, IGHG4, HPX, IGHA2, IGLC2, ITIH1, KNG1, ITIH4, ITIH2, AGT, PLG, APOA4, KRT14, CFB, IGLC1, ITIH4, ORM1, ITIH4, AHSG, A1BG, IGLL5, SERPING1, Ig kappa chain V-I region DEE, APOE, Ig kappa chain V-I region OU, ORM2, AFM, Ig heavy chain V-III region BUT, C4BPA, KRT6A, SERPINF1, APCS, APOH, CLU, KRT5, Ig heavy chain V-III region BRO, Ig heavy chain V-III region GAL, HRG, Ig heavy chain V-III region CAM, VTN, SERPIND1, TTR, PON1, Ig heavy chain V-III region TIL, C1QC, SERPINA7, Ig kappa chain V-I region CAR, Ig kappa chain V-IV region Len, AMBP, KRT13, Ig kappa chain V-III region SIE, SERPINF2, Ig heavy chain V-III region VH26, C5, F2, IGKV4-1, C7, Ig kappa chain V-I region EU, Ig kappa chain V-III region NG9 (Fragment), GSN, LPA, LYZ, Ig kappa chain V-III region HAH, Ig lambda chain V-III region LOI, SERPINA6, AZGP1, C1S, CFHR1, C9, HRNR, APOL1, C1QB, Ig kappa chain V-I region Ni, Ig heavy chain V-III region WEA, Ig kappa chain V-II region TEW, SERPINA4, DCD, LRG1, GSN, RBP4, SMC3, PRSS3, IGJ, C6, SEPP1, HBA1, Ig kappa chain V-III region CLL, ABCF1, APOD, SERPINA5, PDE4D, C2, C8A, C1R, CD5L, CFHR2, FLG2, HBB, CFI, Ig kappa chain V-II region MIL, Ig heavy chain V-II region NEWM, C8G, Ig lambda chain V-III region SH, PGLYRP2, SBSN, Ig lambda chain V-I region WAH, Ig lambda chain V-IV region Hil, SAA4, F10, MASP1, SHROOM3, F13A1, Ig lambda chain V region 4A, GIT2, KLKB1, ATRN, Ig heavy chain V-I region HG3, ITIH3, CDK10, APOA2, Ig heavy chain V-II region OU, Ig heavy chain V-I region V35, UTF1, MAP1B, PAPLN, Ig kappa chain V-I region Lay, RNF207, VPS13D, CRYGN, HMCN1, SLC27A6, FN1, VWF, C8B, LGALS3BP, HP, PROS1, ECM1, HPR, LBP, HABP2, FCN2, KRT77, APOM, Ig kappa chain V-I region WEA, GC, PLA2G7, Ig kappa chain V-I region Scw, CFP, APOM, MASP1, IGKV1-5, F12, SERPINA1, F13B, FCN2, PCYOX1, C4BPB, LCAT, KRT73, Ig heavy chain V-III region GA, Ig kappa chain V-III region VG (Fragment), MBL2, EEF2, MAP3K6, EPHA5, APOC4, CAMP, SERPINA10, FCGBP, PCSK9, CPB2, CFHR5, SAFB2, C2CD4C, F5, NUP153, XYLT1, EP300, BMP8A, N4BP2, KRT4, KRT16, Ig kappa chain V-III region B6, KRT86, KRT85, ANXA1, KRT78, SPRR2E, CLU, CRNN, ARHGEF17, SPRR3, FN1, ARHGAP30, ACTG2, SFTPA1, CDC5L, FN1, IGLC7, FLG, SERPINA1, Ig heavy chain V-III region |

TABLE 4-continued

Illustrative Biomarkers

| Illustrative Class | Biomarkers |
|---|---|
|  | TUR, JUP, DSP, KNG1, KPRP, LCE1C, Ig heavy chain V-II region ARH-77, Ig kappa chain V-III region POM, FBLN1, C1QA, FCN3, Ig lambda chain V-IV region Bau, Ig lambda chain V-VI region WLT, UPF3A, SERPINF2, XIRP2, CFB, SERPINA3, DSG1, TTN, LRRCC1, MYO15A, ANKRD28, Ig heavy chain V-III region HIL, KIT, DNMT1, PLXND1, Ig kappa chain V-I region Mev, IGHD, RCBTB1, BCO1, KRT6B, KRT13, Ig kappa chain V-II region RPMI 6410, Ig kappa chain V-IV region B17, ACTB, FN1, SARDH, GK, EMC4, MED30, PIGR, HSPB1, DSP, VEPH1, SNX27, LRRC53, SIGLEC16, F9, Ig heavy chain V-III region TRO, APOC3, TOP2A, FLYWCH1, ACTL10 |
| Vesicle Associated | KRT6A, DSP, KRT6B, ACTB, FLG, IVL, SFN, KRT77, LMNA, KRT15, LGALS7, HSPA8, EPPK1, HSPA1A, DSG1, GSN, HIST1H2BK, EEF1A1, RPLP2, KRT74, YWHAB, PKP1, JUP, HNRNPA1, HSP90AA1, HIST1H2AH, GAPDH, HIST1H1E, HSPB1, CALML5, DCD, YWHAQ, VCP, AHNAK, SFPQ, PLEC, SERBP1, P4HB, PPL, Ig lambda chain V-IV region Hil, EIF3B, HSPA5, C3, TUBB4A, IGHG1, RPS3A, PPIA, SPTBN2, PDIA3, KRT80, DBNL, RPL29, RPL3, ANXA2P2, TPI1, RDX, H1F0, PGAM2, IGLC2, EVPL, ENO1, HNRNPA2B1, RPL7A, MYL6, ANXA1, TRIM29, RPS19, POF1B, RPL6, MORC2, RTN4, CA/CK E, LYZ, ZDBF2, IGKC, Ig heavy chain V-III region TIL, C4BPA, ACTB, LCE1C, IGHG3, SHOX2, KRT17, KRT77, KRT80, PIGR, KNG1, DSG1, DSP, SHROOM3, FGA, KPRP, DUSP27, LCE1C, SARDH, LYZ, SHISA5, HSP90AB1, EEF1A1, FGB, SHROOM3, IGLC2, KRT85, BMP8A, LCE2B, KRT6A, IGKC, S100A9, EEF1A1, C3, DCD, S100A8, LCE1C, ALB, IGLC2, S100A9, HSP90AB1, ACTB, KRT5, Ig kappa chain V-II region MIL, HRNR, IGHG1, HIST1H4A, DEFA1, LYZ, C3, SHROOM3, Ig kappa chain V-IV region STH (Fragment), Ig lambda chain V-I region HA, IGHA2, SARDH, H3F3C, LTF, TF |
| Vesicle Associated | C3, A2M, APOB, IGKC, C4A, C4B, FGB, ALB, CFH, IGHG1, FGA, FN1, PLG, IGHM, FGG, TF, C5, CP, IGHG2, IGLC2, Ig mu heavy chain disease protein, ITIH1, PZP, IGHG3, IGLL5, HP, C4BPA, ITIH2, IGHA1, KRT1, KRT10, APOE, Ig kappa chain V-I region DEE, AMBP, F2, C7, C6, ITIH4, CFB, IGHG4, APOH, APOA1, CD5L, C1R, HPR, Ig kappa chain V-I region Scw, IGHA2, CFHR1, KRT2, Ig kappa chain V-III region SIE, HRG, Ig heavy chain V-III region BRO, C1QB, GC, Ig heavy chain V-III region TIL, Ig kappa chain V-III region NG9 (Fragment), Ig heavy chain V-III region BUT, Ig heavy chain V-III region TUR, C9, SERPIND1, Ig kappa chain V-I region WEA, Ig kappa chain V-I region Ni, Ig kappa chain V-IV region Len, Ig kappa chain V-I region EU, Ig kappa chain V-II region TEW, Ig heavy chain V-III region GAL, KNG1, VTN, C8B, Ig lambda chain V-III region LOI, Ig heavy chain V-II region NEWM, APCS, KLKB1, CFI, PROS1, LPA, KRT9, SERPINA1, Ig lambda chain V-III region SH, C8A, Ig kappa chain V-III region B6, Ig lambda chain V-IV region Hil, Ig kappa chain V-III region CLL, C1S, FCN3, SERPINC1, Ig kappa chain V-I region Mev, IGHD, C1QC, HPX, C8G, IGKV1-5, Ig kappa chain V-I region Wes, Ig heavy chain V-III region WEA, A1BG, GSN, FBLN1, HBB, ITIH3, F12, SERPINA3, APOC3, Ig kappa chain V-I region BAN, Ig kappa chain V-III region VH (Fragment), F13B, IGKV4-1, SERPINF2, CLU, HIST1H1D, PON1, IGJ, Ig kappa chain V-III region POM, Ig heavy chain V-III region CAM, Ig heavy chain V-III region BUR, Ig kappa chain V-III region VG (Fragment), APOD, Ig lambda chain V-IV region MOL, Ig heavy chain V-III region GAR, FCGBP, APOM, F13A1, Ig heavy chain V-I region HG3, C1QA, Ig lambda chain V-VI region WLT, C2, C4BPB, CFP, SERPINA4, SAA4, SERPINF1, LGALS3BP, HABP2, RCBTB1, APOL1, KCNQ2, F9, Ig heavy chain V-III region TRO, Ig heavy chain V-III region HIL, Ig heavy chain V-III region OU, APOA2, F11, Ig lambda chain V-I region WAH, Ig lambda chain V region 4A, Ig kappa chain V-II region RPMI 6410, Ig kappa chain V-III region IARC/BL41, KRT5, IGLL1, Ig heavy chain V-I region V35, HBA1, ADIPOQ, PGLYRP2, UPF3A, BCO1, ARFGAP3, SARDH, SERPINA1, KNG1, Ig kappa chain V-I region Kue, Ig kappa chain V-I region Lay, Ig kappa chain V-I region OU, Ig kappa chain V-II region MIL, Ig heavy chain V-III region VH26, Ig heavy chain V-III region GA, FN1, TTR, SERPING1, APOA4, PRSS1, ANXA6, CFTR, LBP, FBLN1, SPAG17, PDLIM2, ARHGEF17, IGLC7, AGRN, AGT, RBP4, AHSG, Ig kappa chain V-III region GOL, SERPINA5, GSN, Ig kappa chain V-III region HAH, CFHR2, GIT2, INCENP |
| Vesicle Associated | MUC5B, FABP5, HPX, CP, SPRR2E, SPRR2D, PDE4D, GC, CPD, CD14, LAP3, AFM, FCN2, DMBT1, LIFR, SNX27, LCN1, ARFIP1, APOH, KLKB1, XP32, H2AFV, KRT75, KRT6C, KRT83, KRT76, KRT33B, KRT72, KRT31, KRT73, DSG1, LCE1C, LCE1A, CFB, CFH, SERPINA1, Ig kappa chain V-I region EU, Ig kappa chain V-II region MIL, Ig lambda chain V-IV region Bau, Ig heavy chain V-III region GAL, IGLC6, ACTG2 |

Examples of additional biomarkers that can be incorporated into the methods and compositions of the invention include without limitation those disclosed in International Patent Application Nos. PCT/US2012/042519 (WO 2012/174282), filed Jun. 14, 2012 and PCT/US2012/050030 (WO 2013/022995), filed Aug. 8, 2012.

In various embodiments of the invention, the biomarkers or biosignature used to detect or assess any of the conditions or diseases disclosed herein can comprise one or more biomarkers in one of several different categories of markers, wherein the categories include without limitation one or more of: 1) disease specific biomarkers; 2) cell- or tissue-specific biomarkers; 3) vesicle-specific markers (e.g., general vesicle biomarkers); 4. angiogenesis-specific biomarkers; and 5) immunomodulatory biomarkers. Examples of all such markers are disclosed herein and known to a person having ordinary skill in the art. Furthermore, a biomarker known in the art that is characterized to have a role in a particular disease or condition can be adapted for use as a target in compositions and methods of the invention. In further embodiments, such biomarkers that are associated with vesicles can be all vesicle surface markers, or a combination of vesicle surface markers and vesicle payload markers (i.e., molecules enclosed by a vesicle). The biomarkers assessed can be from a combination of sources. For example, a disease or disorder may be detected or characterized by assessing a combination of proteins, nucleic acids, vesicles, circulating biomarkers, biomarkers from a tissue sample, and the like. In addition, as noted herein, the biological sample assessed can be any biological fluid, or can comprise individual components present within such biological fluid (e.g., vesicles, nucleic acids, proteins, or complexes thereof).

EpCAM is a pan-epithelial differentiation antigen that is expressed on many tumor cells. It is intricately linked with the Cadherin-Catenin pathway and hence the fundamental WNT pathway responsible for intracellular signalling and polarity. It has been used as an immunotherapeutic target in the treatment of gastrointestinal, urological and other carcinomas. (Chaudry Mass., Sales K, Ruf P, Lindhofer H, Winslet M C (April 2007). *Br. J. Cancer* 96 (7): 1013-9.). It is expressed in undifferentiated pluripotent stem cells. EpCAM is a member of a family that includes at least two type I membrane proteins and functions as a homotypic calcium-independent cell adhesion molecule. Mutations in this gene result in congenital tufting enteropathy. EpCAM has been observed on the surface of microvesicles derived from cancer cell of various lineages. EpCAM is used as an exemplary surface antigen in various examples herein. One of skill will appreciate that various embodiments and examples using EpCAM can be applied to other microvesicle surface antigens as well.

Oligonucleotide Probe Methods

Nucleic acid sequences fold into secondary and tertiary motifs particular to their nucleotide sequence. These motifs position the positive and negative charges on the nucleic acid sequences in locations that enable the sequences to bind to specific locations on target molecules, e.g., proteins and other amino acid sequences. These binding sequences are known in the field as aptamers. Due to the trillions of possible unique nucleotide sequences in even a relatively short stretch of nucleotides (e.g., 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides), a large variety of motifs can be generated, resulting in aptamers for almost any desired protein or other target.

Aptamers are created by randomly generating oligonucleotides of a specific length, typically 20-80 base pairs long, e.g., 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79 or 80 base pairs. These random oligonucleotides are then incubated with the protein target of interest. After several wash steps, the oligonucleotides that bind to the target are collected and amplified. The amplified aptamers are then added to the target and the process is repeated, often 15-20 times. A common version of this process known to those of skill in the art as the SELEX method.

The end result comprises one or more aptamer with high affinity to the target. The invention provides further processing of such resulting aptamers that can be use to provide desirable characteristics: 1) competitive binding assays to identify aptamers to a desired epitope; 2) motif analysis to identify high affinity binding aptamers in silico; and 3) microvesicle-based aptamer selection assays to identify aptamers that can be used to detect a particular disease. The methods are described in more detail below and further in the Examples.

The invention further contemplates aptamer sequences that are highly homologous to the sequences that are discovered by the methods of the invention. "High homology" typically refers to a homology of 40% or higher, preferably 60% or higher, more preferably 80% or higher, even more preferably 85%, 90%, 91%, 92%, 93%, 94%, 95%, 96%, 97%, 98%, 99% or higher between a polynucleotide sequence sequence and a reference sequence. In an embodiment, the reference sequence comprises the sequence of one or more aptamer provided herein. Percent homologies (also referred to as percent identity) are typically carried out between two optimally aligned sequences. Methods of alignment of sequences for comparison are well-known in the art. Optimal alignment of sequences and comparison can be conducted, e.g., using the algorithm in "Wilbur and Lipman, Proc Natl Acad Sci USA 80: 726-30 (1983)". Homology calculations can also be performed using BLAST, which can be found on the NCBI server at: www.ncbi.nlm.nih.gov/BLAST/(Altschul S F, et al, Nucleic Acids Res. 1997; 25(17):3389-402; Altschul S F, et al, J Mol. Biol. 1990; 215(3):403-10). In the case of an isolated polynucleotide which is longer than or equivalent in length to the reference sequence, e.g., a sequence identified by the methods herein, the comparison is made with the full length of the reference sequence. Where the isolated polynucleotide is shorter than the reference sequence, e.g., shorter than a sequence identified by the methods herein, the comparison is made to a segment of the reference sequence of the same length (excluding any loop required by the homology calculation).

The invention further contemplates aptamer sequences that are functional fragments of the sequences that are discovered by the methods of the invention. In the context of an aptamer sequence, a "functional fragment" of the aptamer sequence may comprise a subsequence that binds to the same target as the full length sequence. In some instances, a candidate aptamer sequence is from a member of a library that contains a 5' leader sequences and/or a 3' tail sequence. Such leader sequences or tail sequences may serve to facilitate primer binding for amplification or capture, etc. In these embodiments, the functional fragment of the full length sequence may comprise the subsequence of the candidate aptamer sequence absent the leader and/or tail sequences.

Competitive Antibody Addition

Known aptamer production methods may involve eluting all bound aptamers from the target sequence. In some cases, this is not sufficient to identify the desired aptamer sequence. For example, when trying to replace an antibody in an assay, it may be desirable to only collect aptamers that bind to the specific epitope of the antibody being replaced. The invention provides a method comprising addition of an antibody that is to be replaced to the aptamer/target reaction in order to allow for the selective collection of aptamers which bind to the antibody epitope. In an embodiment, the method comprises incubating a reaction mixture comprising randomly generated oligonucleotides with a target of interest, removing unbound aptamers from the reaction mixture that do not bind the target, adding an antibody to the reaction mixture that binds to that epitope of interest, and collecting the aptamers that are displaced by the antibody. The target can be a protein. See, e.g., FIG. 1, which illustrates the method for identifying an aptamer to a specific epitope of EpCam.

Motif Analysis

Figure 3A:
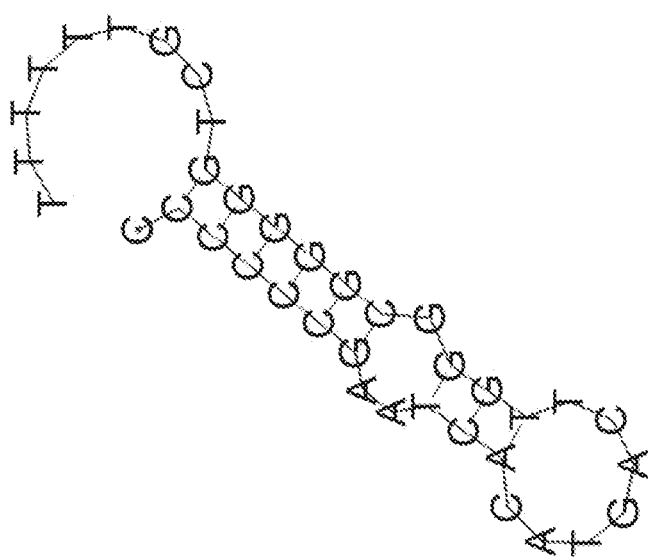
FIGS. 3A-B illustrates a non-limiting example of an aptamer nucleotide sequence and its secondary structure.
Figure 3B:
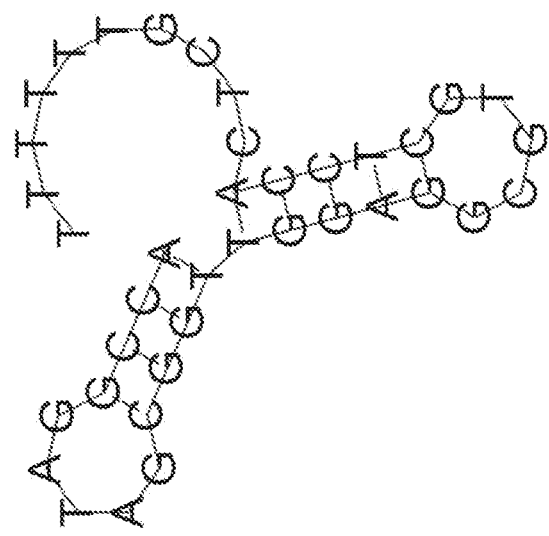

In most aptamer experiments, multiple aptamer sequences are identified that bind to the target. These aptamers will have various binding affinities. It can be time consuming and laborious to generate quantities of these many aptamers sufficient to assess the affinities of each. To identify large numbers of aptamers with the highest affinities without physically screening large subsets, the invention provides a method comprising the analysis of the two dimensional structure of one or more high affinity aptamers to the target of interest. In an embodiment, the method comprises screening the database for aptamers that have similar two-dimensional structures, or motifs, but not necessarily similar primary sequences. In an embodiment, the method comprises identifying a high affinity aptamer using traditional methods such as disclosed herein or known in the art (e.g. surface plasmon resonance binding assay, see FIG. 5), approximating the two-dimensional structure of the high affinity aptamer, and identifying aptamers from a pool of sequences that are predicted to have a similar two-dimensional structure to the high affinity aptamer. The method thereby provides a pool of candidates that also bind the target of interest. The two-dimensional structure of an oligo can be predicting using methods known in the art, e.g., via free energy ($\Delta G$) calculations performed using a commercially available software program such as Vienna or mFold, for example as described in Mathews, D., Sabina, J., Zucker, M. & Turner, H. Expanded sequence dependence of thermodynamic parameters provides robust prediction of RNA secondary structure. J. Mol. Biol. 288, 911-940 (1999); Hofacker et al., Monatshefte f. Chemie 125: 167-188 (1994); and Hofacker, I. L. Vienna RNA secondary structure server. Nucleic Acids Res. 31, 3429-3431 (2003), the contents of which are incorporated herein by reference in their entirety. See FIGS. 3A-3B. The pool of sequences can be sequenced from a pool of randomly generated aptamer candidates using a high-throughput sequencing platform, such as the Ion Torrent platform from Life Technologies. Identifying aptamers from a pool of sequences that are predicted to have a similar two-dimensional structure to the high affinity aptamer may comprise loading the resulting sequences into the software program of choice to identify members of the pool of sequences with similar two-dimensional structures as the high affinity aptamer. The affinities of the pool of sequences can then be determined in situ, e.g., surface plasmon resonance binding assay or the like.

Aptamer Subtraction Methods

In order to develop an assay to detect a disease, for example, cancer, one typically screens a large population of known biomarkers from normal and diseased patients in order to identify markers that correlate with disease. This process only works if discriminating markers are already described. In order to address this problem, the invention provides a method comprising subtracting out non-discriminating aptamers from a large pool of aptamers by incubating them initially with non-target microvesicles or cells. The non-target cells can be normal cells or microvesicles shed therefrom. The aptamers that did not bind to the normal microvesicles or cells are then incubated with diseased microvesicles or cells. The aptamers that bind to the diseased microvesicles or cells but that did not bind to the normal cells are then possible candidates for an assay to detect the disease. This process is independent of knowing the existence of a particular marker in the diseased sample.

Subtraction methods can be used to identify aptamers that preferentially recognize a desired population of targets. In an embodiment, the subtraction method is used to identify aptamers that preferentially recognize target from a diseased target population over a control (e.g., normal or non-diseased) population. The diseased target population may be a population of vesicles from a diseased individual or individuals, whereas the control population comprises vesicles from a non-diseased individual or individuals. The disease can be a cancer or other disease disclosed herein or known in the art. Accordingly, the method provides aptamers that preferentially identify disease targets versus control targets.

Circulating microvesicles can be isolated from control samples, e.g., plasma from "normal" individuals that are absent a disease of interest, such as an absence of cancer. Vesicles in the sample are isolated using a method disclosed herein or as known in the art. For example, vesicles can be isolated from the plasma by one of the following methods: filtration, ultrafiltration, nanomembrane ultrafiltration, the ExoQuick reagent (System Biosciences, Inc., Mountain View, Calif.), centrifugation, ultracentrifugation, using a molecular crowding reagent (e.g., TEXIS from Life Technologies), polymer precipitation (e.g., polyethylene glycol (PEG)), affinity isolation, affinity selection, immunoprecipitation, chromatography, size exclusion, or a combination of any of these methods. The microvesicles isolated in each case will be a mixture of vesicle types and will be various sizes although ultracentrifugation methods may have more tendencies to produce exosomal-sized vesicles. Randomly generated oligonucleotide libraries (e.g., produced as described in the Examples herein) are incubated with the isolated normal vesicles. The aptamers that do not bind to these vesicles are isolated, e.g., by spinning down the vesicles and collecting the supernatant containing the non-binding aptamers. These non-binding aptamers are then contacted with vesicles isolated from diseased patients (e.g., using the same methods as described above) to allow the aptamers to recognize the disease vesicles. Next, aptamers that are bound to the diseased vesicles are collected. In an embodiment, the vesicles are isolated then lysed using a chaotropic agent (e.g., SDS or a similar detergent), and the aptamers are then captured by running the lysis mixture over an affinity column. The affinity column may comprise streptavidin beads in the case of biotin conjugated aptamer pools. The isolated aptamers are the amplified. The process can then then repeated, e.g., 1, 2, 3, 4, 5, 6, 7, 8, 9, 10, 11, 12, 13, 14, 15, 16, 17, 18, 19 or 20 or more times.

In one aspect of the invention, an aptamer profile is identified that can be used to characterize a biological sample of interest. In an embodiment, a pool of randomly generated oligonucleotides, e.g., at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ oligonucleotides, is contacted with a biological component or target of interest from a control population. The oligonucleotides that do not bind the biological component or target of interest from the control population are isolated and then contacted with a biological component or target of interest from a test population. The oligonucleotides that bind the biological component or target of interest from the test population are retained. The retained oligonucleotides can be used to repeat the process by contacting the retained oligonucleotides with the biological component or target of interest from the control population, isolating the retained oligonucleotides that do not bind the biological component or target of interest from the control population, and again contacting these isolated oligonucleotides with the biological component or target of interest from the test population and isolating the binding oligonucleotides. The "component" or "target" can be anything that is present in sample to which the oligonucleotides are capable of binding (e.g., polypeptides, peptide, nucleic acid molecules, carbohydrates, lipids, etc.). The process can be repeated any number of desired iterations, e.g., 1, 2, 3, 4, 5, 6, 7, 8, 9, 10, 11, 12, 13, 14, 15, 16, 17, 18, 19 or 20 or more times. The resulting oligonucleotides comprise aptamers that can differentially detect the test population versus the control. These aptamers provide an aptamer profile, which comprises a biosignature that is determined using one or more aptamer, e.g., a biosignature comprising a presence or level of the component or target which is detected using the one or more aptamer.

Figure 4:
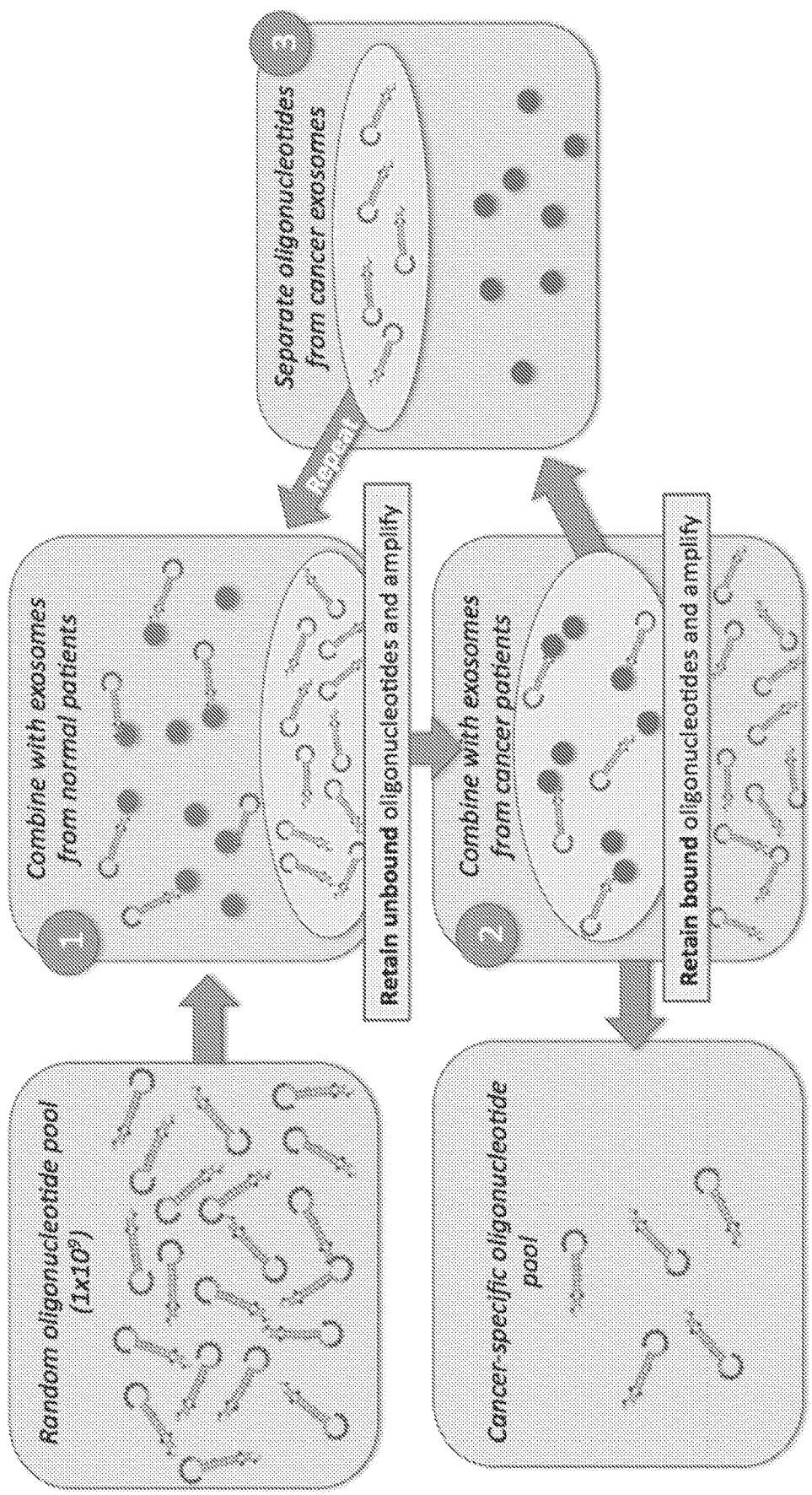
FIG. 4 illustrates a process for producing a target-specific set of aptamers using a cell subtraction method, wherein the target is a biomarker associated with a specific disease. In Step 1, a random pool of oligonucleotides are contacted with a biological sample from a normal patient. In Step 2, the oligos that did not bind in Step 1 are added to a biological sample isolated from diseased patients. The bound oligos from this step are then eluted, captured via their biotin linkage and then combined again with normal biological sample. The unbound oligos are then added again to disease-derived biological sample and isolated. This process can be repeated iteratively. The final eluted aptamers are tested against patient samples to measure the sensitivity and specificity of the set. Biological samples can include blood, including plasma or serum, or other components of the circulatory system, such as microvesicles.

An exemplary process is illustrated in FIG. 4, which demonstrates the method to identify aptamer that preferentially recognize cancer vesicles using vesicles from normal (non-cancer) individuals as a control. In the figure, exosomes are exemplified but one of skill will appreciate that other microvesicles can be used in the same manner. The resulting aptamers can provide a profile that can differentially detect the cancer vesicles from the normal vesicles. One of skill will appreciate that the same steps can be used to derive an aptamer profile to characterize any disease or condition of interest.

In an embodiment, the invention provides an isolated polynucleotide that encodes a polypeptide, or a fragment thereof, identified by the methods above. The invention further provides an isolated polynucleotide having a nucleotide sequence that is at least 60% identical to the nucleotide sequence identified by the methods above. More preferably, the isolated nucleic acid molecule is at least 65%, 70%, 75%, 80%, 85%, 90%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

In a related aspect, the invention provides a method of characterizing a biological phenotype using an aptamer profile. The aptamer profile can be determined using the method above. The aptamer profile can be determined for a test sample and compared to a control aptamer profile. The phenotype may be a disease or disorder such as a cancer. Characterizing the phenotype can include without limitation providing a diagnosis, prognosis, or theranosis. Thus, the aptamer profile can provide a diagnostic, prognostic and/or theranostic readout for the subject from whom the test sample is obtained.

In another embodiment, an aptamer profile is determined for a test sample by contacting a pool of aptamer molecules to the test sample, contacting the same pool of aptamers to a control sample, and identifying one or more aptamer molecules that differentially bind a component or target in the test sample but not in the control sample (or vice versa). A "component" or "target" as used in the context of the biological test sample or control sample can be anything that is present in sample to which the aptamers are capable of binding (e.g., polypeptides, peptide, nucleic acid molecules, carbohydrates, lipids, etc.). For example, if a sample is a plasma or serum sample, the aptamer molecules may bind a polypeptide biomarker that is solely expressed or differentially expressed (over- or underexpressed) in a disease state as compared to a non-diseased subject. Comparison of the aptamer profile in the test sample as compared to the control sample may be based on qualitative and quantitative measure of aptamer binding (e.g., binding versus no binding, or level of binding in test sample versus different level of binding in the reference control sample).

In an aspect, the invention provides a method of identifying a target-specific aptamer profile, comprising contacting a biological test sample with a pool of aptamer molecules, contacting the pool to a control biological sample, identifying one or more aptamers that bind to a component in said test sample but not to the control sample, thereby identifying an aptamer profile for said biological test sample. In an embodiment, a pool of aptamers is selected against a disease sample and compared to a reference sample, the aptamers in a subset that bind to a component(s) in the disease sample but not in the reference sample can be sequenced using conventional sequencing techniques to identify the subset that bind, thereby identifying an aptamer profile for the particular disease sample. In this way, the aptamer profile provides an individualized platform for detecting disease in other samples that are screened. Furthermore, by selecting an appropriate reference or control sample, the aptamer profile can provide a diagnostic, prognostic and/or theranostic readout for the subject from whom the test sample is obtained.

In a related aspect, the invention provides a method of selecting a pool of aptamers, comprising: (a) contacting a biological control sample with a pool of oligonucleotides; (b) isolating a first subset of the pool of oligonucleotides that do not bind the biological control sample; (c) contacting the biological test sample with the first subset of the pool of oligonucleotides; and (d) isolating a second subset of the pool of oligonucleotides that bind the biological test sample, thereby selecting the pool of aptamers. The pool of oligonucleotides may comprise any number of desired sequences, e.g., at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ oligonucleotides may be present in the starting pool. Steps (a)-(d) may be repeated to further hone the pool of aptamers. In an embodiment, these steps are repeated at least 1, 2, 3, 4, 5, 6, 7, 8, 9, 10, 11, 12, 13, 14, 15, 16, 17, 18, 19 or at least 20 times.

As described herein, the biological test sample and biological control sample may comprise microvesicles. In an embodiment, the biological test sample and optionally biological control sample comprise a bodily fluid. The bodily fluid may comprise without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, Cowper's fluid, pre-ejaculatory fluid, female ejaculate, sweat, fecal matter, hair, tears, cyst fluid, pleural fluid, peritoneal fluid, malignant fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids. The biological test sample and optionally biological control may also comprise a tumor sample, e.g., cells from a tumor or tumor tissue. In other embodiments, the biological test sample and optionally biological control sample comprise a cell culture medium. In embodiments, the biological test sample comprises a diseased sample and the biological control sample comprises a non-diseased sample. Accordingly, the pool of aptamers may be used to provide a diagnostic, prognostic and/or theranostic readout a disease.

As noted, the invention can be used to assess microvesicles. Microvesicles are powerful biomarkers because the vesicles provide one biological entity that comprises multiple pieces of information. For example as described, a vesicle can have multiple surface antigens, each of which provides complementary information. Consider a cancer marker and a tissue specific marker. If both markers are individually present in a sample, e.g., both are circulating proteins or nucleic acids, it may not be ascertainable whether the cancer marker and the tissue specific marker are derived from the same anatomical locale. However, if both the cancer marker and the tissue specific marker are surface antigens on a single microvesicle, the vesicle itself links the two markers and provides an indication of a disease (via the cancer marker) and origin of the disease (via the tissue specific marker). Furthermore, the vesicle can have any number of surface antigens and also payload that can be assessed. Accordingly, the invention provides a method for identifying binding agents comprising contacting a plurality of extracellular microvesicles with a randomly generated library of binding agents, identifying a subset of the library of binding agents that have an affinity to one or more components of the extracellular microvesicles. The binding agents may comprise aptamers, antibodies, and/or any other useful type of binding agent disclosed herein or known in the art.

In a related aspect, the invention provides a method for identifying a plurality of target ligands comprising, (a) contacting a reference microvesicle population with a plurality of ligands that are capable of binding one or more microvesicle surface markers, (b) isolating a plurality of reference ligands, wherein the plurality of reference ligands comprise a subset of the plurality of ligands that do not have an affinity for the reference microvesicle population; (c) contacting one or more test microvesicle with the plurality of reference ligands; and (d) identifying a subset of ligands from the plurality of reference ligands that form complexes with a surface marker on the one or more test microvesicle, thereby identifying the plurality of target ligands. The term "ligand" can refer a molecule, or a molecular group, that binds to another chemical entity to form a larger complex. Accordingly, a binding agent comprises a ligand. The plurality of ligands may comprise aptamers, antibodies and/or other useful binding agents described herein or known in the art.

The invention further provides kits comprising one or more reagent to carry out the methods above. In an embodiment, the one or more reagent comprises a library of potential binding agents that comprises one or more of an aptamer, antibody, and other useful binding agents described herein or known in the art.

Negative and Positive Aptamer Selection

Aptamers can be used in various biological assays, including numerous types of assays which rely on a binding agent. For example, aptamers can be used instead of or along side antibodies in immune-based assays. The invention provides an aptamer screening method that identifies aptamers that do not bind to any surfaces (substrates, tubes, filters, beads, other antigens, etc.) throughout the assay steps and bind specifically to an antigen of interest. The assay relies on negative selection to remove aptamers that bind non-target antigen components of the final assay. The negative selection is followed by positive selection to identify aptamers that bind the desired antigen.

In an aspect, the invention provides a method of identifying an aptamer specific to a target of interest, comprising (a) contacting a pool of candidate aptamers with one or more assay components, wherein the assay components do not comprise the target of interest; (b) recovering the members of the pool of candidate aptamers that do not bind to the one or more assay components in (a); (c) contacting the members of the pool of candidate aptamers recovered in (b) with the target of interest in the presence of one or more confounding target; and (d) recovering a candidate aptamer that binds to the target of interest in step (c), thereby identifying the aptamer specific to the target of interest. In the method, steps (a) and (b) provide negative selection to remove aptamers that bind non-target entities. Conversely, steps (c) and (d) provide positive selection by identifying aptamers that bind the target of interest but not other confounding targets, e.g., other antigens that may be present in a biological sample which comprises the target of interest. The pool of candidate aptamers may comprise at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ nucleic acid sequences. One illustrative approach for performing the method is provided in Example 7.

In some embodiments, steps (a)-(b) are optional. In other embodiments, steps (a)-(b) are repeated at least 1, 2, 3, 4, 5, 6, 7, 8, 9, 10, 11, 12, 13, 14, 15, 16, 17, 18, 19 or at least 20 times before positive selection in step (c) is performed. The positive selection can also be performed in multiple rounds. Steps (c)-(d) can be repeated at least 1, 2, 3, 4, 5, 6, 7, 8, 9, 10, 11, 12, 13, 14, 15, 16, 17, 18, 19 or at least 20 times before identifying the aptamer specific to the target of interest. Multiple rounds may provide improved stringency of selection.

In some embodiments, the one or more assay components contacted with the aptamer pool during negative selection comprise one or more of a substrate, a bead, a planar array, a column, a tube, a well, or a filter. One of skill will appreciate that the assay components can include any substance that may be part of a biological assay.

The target of interest can be any appropriate entity that can be detected when recognized by an aptamer. In an embodiment, the target of interest comprises a protein or polypeptide. As used herein, "protein," "polypeptide" and "peptide" are used interchangeably unless stated otherwise. The target of interest can be a nucleic acid, including DNA, RNA, and various subspecies of any thereof as disclosed herein or known in the art. The target of interest can comprise a lipid. The target of interest can comprise a carbohydrate. The target of interest can also be a complex, e.g., a complex comprising protein, nucleic acids, lipids and/or carbohydrates. In some embodiments, the target of interest comprises a microvesicle. In such cases, the aptamer can be a binding agent to a microvesicle surface antigen, e.g., a protein. General microvesicle surface antigens include tetraspanin, CD9, CD63, CD81, CD63, CD9, CD81, CD82, CD37, CD53, Rab-5b, Annexin V, and MFG-E8. Additional general microvesicle surface antigens are provided in Table 3 herein.

The microvesicle surface antigen can also be a biomarker of a disease or disorder. In such cases, the aptamer may be used to provide a diagnosis, prognosis or theranosis of the disease or disorder. For example, the one or more protein may comprise one or more of PSMA, PCSA, B7H3, EpCam, ADAM-10, BCNP, EGFR, IL1B, KLK2, MMP7, p53, PBP, SERPINB3, SPDEF, SSx2, and SSx4. These markers can be used detect a prostate cancer. Additional microvesicle surface antigens are provided in Tables 3-4 herein.

The one or more confounding target can be an antigen other than the target of interest. For example, a confounding target can be another entity that may be present in a sample to be assayed. As a non-limiting example, consider that the sample to be assessed is a plasma sample from an individual. The target of interest may be a protein, e.g., a microvesicle surface antigen, which is present in the sample. In this case, a confounding target could be selected from any other antigen that is likely to be present in the plasma sample. Accordingly, the positive selection should provide candidate aptamers that recognize the target of interest but have minimal, if any, interactions with the confounding targets. In some embodiments, the target of interest and the one or more confounding target comprise the same type of biological entity, e.g., all protein, all nucleic acid, all carbohydrate, or all lipids. As a non-limiting example, the target of interest can be a protein selected from the group consisting of SSx4, SSx2, PBP, KLK2, SPDEF, and EpCAM, and the one or more confounding target comprises the other members of this group. In other embodiments, the target of interest and the one or more confounding target comprise different types of biological entities, e.g., any combination of protein, nucleic acid, carbohydrate, and lipids. The one or more confounding targets may also comprise different types of biological entities, e.g., any combination of protein, nucleic acid, carbohydrate, and lipids.

In an embodiment, the invention provides an isolated polynucleotide, or a fragment thereof, identified by the methods above. The invention further provides an isolated polynucleotide having a nucleotide sequence that is at least 60% identical to the nucleotide sequence identified by the methods above. More preferably, the isolated nucleic acid molecule is at least 65%, 70%, 75%, 80%, 85%, 90%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

In a related aspect, the invention provides a method of selecting a group of aptamers, comprising: (a) contacting a pool of aptamers to a population of microvesicles from a first sample; (b) enriching a subpool of aptamers that show affinity to the population of microvesicles from the first sample; (c) contacting the subpool to a second population of microvesicles from a second sample; and (d) depleting a second subpool of aptamers that show affinity to the second population of microvesicles from the second sample, thereby selecting the group of aptamers that have preferential affinity for the population of microvesicles from the first sample.

The first sample and/or second sample may comprise a biological fluid such as disclosed herein. For example, the biological fluid may include without limitation blood, a blood derivative, plasma, serum or urine. The first sample and/or second sample may also be derived from a cell culture.

In an embodiment, the first sample comprises a cancer sample and the second sample comprises a control sample, such as a non-cancer sample. The first sample and/or and the second sample may each comprise a pooled sample. For example, the first sample and/or second sample can comprise bodily fluid from 2, 3, 4, 5, 6, 7, 8, 9, 10, 11, 12, 13, 14, 15, 16, 17, 18, 19, 20, 25, 30, 40, 50, 60, 70, 80, 90, 100 or more than 100 individuals. In such cases, the members of a pool may be chosen to represent a desired phenotype. In a non-limiting example, the members of the first sample pool may be from patients with a cancer and the members of the second sample pool may be from non-cancer controls.

Steps (a)-(d) can be repeated a desired number of times in order to further enrich the pool in aptamers that have preferential affinity for the population of microvesicles from the first sample. For example, steps (a)-(d) can be repeated 1, 2, 3, 4, 5, 6, 7, 8, 9, 10, 11, 12, 13, 14, 15, 16, 17, 18, 19, 20 or more than 20 times. The output from step (d) can be used as the input to repeated step (a). In embodiment, the first sample and/or second sample are replaced with a different sample before repeating steps (a)-(d). In a non-limiting example, members of a first sample pool may be from patients with a cancer and members of a second sample pool may be from non-cancer controls. During subsequent repetitions of steps (a)-(d), the first sample pool may comprise samples from different cancer patients than in the prior round/s. Similarly, the second sample pool may comprise samples from different controls than in the prior round/s.

In still another related aspect, the invention provides a method of enriching a plurality of oligonucleotides, comprising: (a) contacting a first microvesicle population with the plurality of oligonucleotides; (b) fractionating the first microvesicle population contacted in step (a) and recovering members of the plurality of oligonucleotides that fractionated with the first microvesicle population; (c) contacting the recovering members of the plurality of oligonucleotides from step (b) with a second microvesicle population; (d) fractionating the second microvesicle population contacted in step (c) and recovering members of the plurality of oligonucleotides that did not fractionate with the second microvesicle population; (e) contacting the recovering members of the plurality of oligonucleotides from step (d) with a third microvesicle population; and (f) fractionating the third microvesicle population contacted in step (a) and recovering members of the plurality of oligonucleotides that fractionated with the third microvesicle population; thereby enriching the plurality of oligonucleotides. The first and third microvesicle populations may have a first phenotype while the second microvesicle population has a second phenotype. Thus, positive selection occurs for the microvesicle populations associated with the first phenotype and negative selection occurs for the microvesicle populations associated with the second phenotype. An example of such selection schemes is described in Example 18 herein, wherein the first phenotype comprises biopsy-positive breast cancer and the second phenotype comprises non-breast cancer (biopsy-negative or healthy).

In some embodiments, the first phenotype comprises a medical condition, disease or disorder and the second phenotype comprises a healthy state or a different state of the medical condition, disease or disorder. The first phenotype can be a healthy state and the second phenotype comprises a medical condition, disease or disorder. The medical condition, disease or disorder can be any detectable medical condition, disease or disorder, including without limitation a cancer, a premalignant condition, an inflammatory disease, an immune disease, an autoimmune disease or disorder, a cardiovascular disease or disorder, neurological disease or disorder, infectious disease or pain. Various types of such conditions are disclosed herein. See, e.g., Section "Phenotypes" herein.

Any useful method to isolate microvesicles in whole or in part can be used to fractionate the samples. See, e.g., Section "Microvesicle Isolation and Analysis" herein. In an embodiment, the fractionating comprises ultracentrifugation in step (b) and polymer precipitation in steps (d) and (f). The polymer can be polyethylene glycol (PEG). Any appropriate form of PEG may be used. For example, the PEG may be PEG 8000. The PEG may be used at any appropriate concentration. For example, the PEG can be used at a concentration of 1%, 2%, 3%, 4%, 5%, 6%, 7%, 8%, 9%, 10%, 11%, 12%, 13%, 14% or 15% to isolate the microvesicles. In some embodiments, the PEG is used at a concentration of 6%.

The contacting can be performed in the presence of a competitor, which may reduce non-specific binding events. Any useful competitor can be used. In an embodiment, the competitor comprises at least one of salmon sperm DNA, tRNA, dextran sulfate and carboxymethyl dextran. As desired, different competitors or competitor concentrations can be used at different contacting steps.

The method can be repeated to achieve a desired enrichment. In an embodiment, steps (a)-(f) are repeated at least once. These steps can be repeated 1, 2, 3, 4, 5, 6, 7, 8, 9, 10, 11, 12, 13, 14, 15, 16, 17, 18, 19, 20, or more than 20 times as desired. At the same time, each of the contacting steps can be repeated as desired. In some embodiments, the method further comprises: (i) repeating steps (a)-(b) at least once prior to step (c), wherein the recovered members of the plurality of oligonucleotides that fractionated with the first microvesicle population in step (b) are used as the input plurality of oligonucleotides for the repetition of step (a); (ii) repeating steps (c)-(d) at least once prior to step (e), wherein the recovered members of the plurality of oligonucleotides that did not fractionate with the second microvesicle population in step (d) are used as the input plurality of oligonucleotides for the repetition of step (c); and/or (iii) repeating steps (e)-(f) at least once, wherein the recovered members of the plurality of oligonucleotides that fractionated with the third microvesicle population in step (f) are used as the input plurality of oligonucleotides for the repetition of step (e). Repetitions (i)-(iii) can be repeated any desired number of times, e.g., (i)-(iii) can be repeated 1, 2, 3, 4, 5, 6, 7, 8, 9, 10, 11, 12, 13, 14, 15, 16, 17, 18, 19, 20 or more than 20 times. In an embodiment, (i)-(iii) each comprise three repetitions.

The method may further comprise identifying the members of the selected group of aptamers or oligonucleotides, e.g., by DNA sequencing. The sequencing may be performed by Next Generation sequencing as desired and after or before any desired step in the method.

The method may also comprise identifying the targets of the selected group of aptamers/oligonucleotides. Methods to identify such targets are disclosed herein.

Oligonucleotide Probe Target Identification

The methods and kits above can be used to identify binding agents that differentiate between two biomarker populations. The invention further provides methods of identifying the targets of binding agent. For example, the methods may further comprise identifying a surface marker of a target microvesicle that is recognized by the binding agent.

In an embodiment, the invention provides a method of identifying a target of a binding agent comprising: (a) contacting the binding agent with the target to bind the target with the binding agent, wherein the target comprises a surface antigen of a microvesicle; (b) disrupting the microvesicle under conditions which do not disrupt the binding of the target with the binding agent; (c) isolating the complex between the target and the binding agent; and (d) identifying the target bound by the binding agent. The binding agent can be a binding agent identified by the methods above, e.g., an aptamer, ligand, antibody, or other useful binding agent that can differentiate between two populations of biomarkers.

Figure 9:
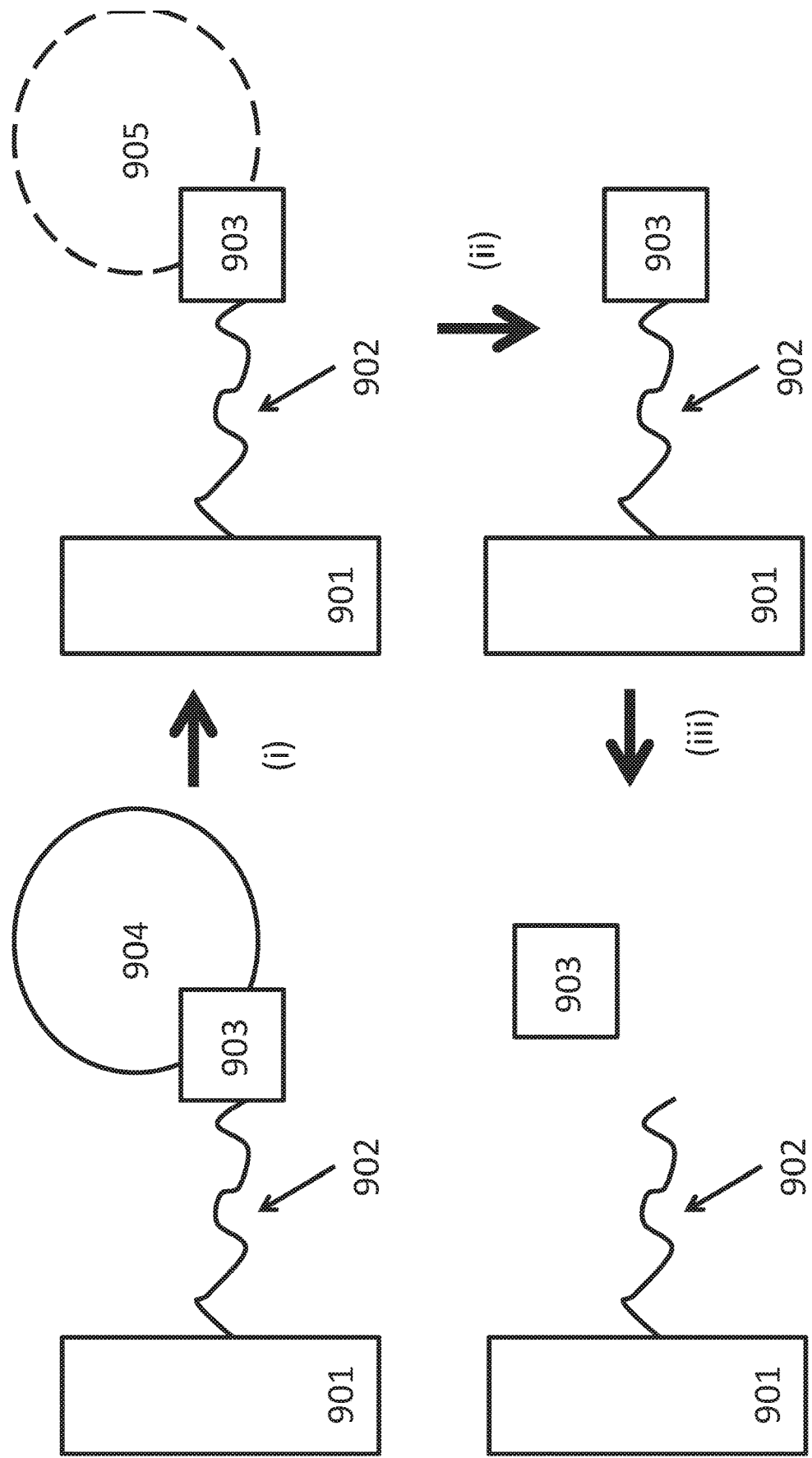
FIG. 9 comprises a schematic for identifying a target of a selected aptamer, such as an aptamer selected by the process of the invention. The figure shows a binding agent 902, here an aptamer for purposes of illustration, tethered to a substrate 901. The binding agent 902 can be covalently attached to substrate 901. The binding agent 902 may also be non-covalently attached. For example, binding agent 902 can comprise a label which can be attracted to the substrate, such as a biotin group which can form a complex with an avidin/streptavidin molecule that is covalently attached to the substrate. The binding agent 902 binds to a surface antigen 903 of microvesicle 904. In the step signified by arrow (i), the microvesicle is disrupted while leaving the complex between the binding agent 902 and surface antigen 903 intact. Disrupted microvesicle 905 is removed, e.g., via washing or buffer exchange, in the step signified by arrow (ii). In the step signified by arrow (iii), the surface antigen 903 is released from the binding agent 902. The surface antigen 903 can be analyzed to determine its identity.

An illustrative schematic for carrying on the method is shown in FIG. 9. The figure shows a binding agent 902, here an oligonucleotide probe or aptamer for purposes of illustration, tethered to a substrate 901. The binding agent 902 can be covalently attached to substrate 901. The binding agent 902 may also be non-covalently attached. For example, binding agent 902 can comprise a label which can be attracted to the substrate, such as a biotin group which can form a complex with an avidin/streptavidin molecule that is covalently attached to the substrate. This can allow a complex to be formed between the aptamer and the microvesicle while in solution, followed by capture of the aptamer using the biotin label. The binding agent 902 binds to a surface antigen 903 of microvesicle 904. In the step signified by arrow (i), the microvesicle is disrupted while leaving the complex between the binding agent 902 and surface antigen 903 intact. Disrupted microvesicle 905 is removed, e.g., via washing or buffer exchange, in the step signified by arrow (ii). In the step signified by arrow (iii), the surface antigen 903 is released from the binding agent 902. The surface antigen 903 can be analyzed to determine its identity using methods disclosed herein and/or known in the art. The target of the method can be any useful biological entity associated with a microvesicle. For example, the target may comprise a protein, nucleic acid, lipid or carbohydrate, or other biological entity disclosed herein or known in the art.

In some embodiments of the method, the target is cross-linked to the binding agent prior disrupting the microvesicle. Without being bound by theory, this step may assist in maintaining the complex between the binding agent and the target while the vesicle is disrupted. Any useful method of crosslinking disclosed herein or known in the art can be used. In embodiments, the cross-linking comprises photocrosslinking, an imidoester crosslinker, dimethyl suberimidate, an N-Hydroxysuccinimide-ester crosslinker, bissulfosuccinimidyl suberate (BS3), an aldehyde, acrolein, crotonaldehyde, formaldehyde, a carbodiimide crosslinker, N,N'-dicyclohexylcarbodiimide (DDC), N,N'-diisopropylcarbodiimide (DIC), 1-Ethyl-3-[3-dimethylaminopropyl] carbodiimide hydrochloride (EDC or EDAC), Succinimidyl-4-(N-maleimidomethyl)cyclohexane-1-carboxylate (SMCC), a Sulfosuccinimidyl-4-(N-maleimidomethyl)cyclohexane-1-carboxylate (Sulfo-SMCC), a Sulfo-N-hydroxysuccinimidyl-2-(6-[biotinamido]-2-(p-azido benzamido)-hexanoamido) ethyl-1,3'-dithioproprionate (Sulfo-SBED), 2-[N2-(4-Azido-2,3,5,6-tetrafluorobenzoyl)-N6-(6-biotin-amidocaproyl)-L-lysinyl]ethyl methanethiosulfonate (Mts-Atf-Biotin; available from Thermo Fisher Scientific Inc, Rockford Ill.), 2-{N2-[N6-(4-Azido-2,3,5,6-tetrafluorobenzoyl-6-amino-caproyl)-N6-(6-biotinamidocaproyl)-L-lysinylamido]}ethyl methanethiosultonate (Mts-Atf-LC-Biotin; available from Thermo Fisher Scientific Inc), a photoreactive amino acid (e.g., L-Photo-Leucine and L-Photo-Methionine, see, e.g., Suchanek, M., et al. (2005). Photo-leucine and photo-methionine allow identification of protein-protein interactions. Nat. Methods 2:261-267), an N-Hydroxysuccinimide (NHS) crosslinker, an NHS-Azide reagent (e.g., NHS-Azide, NHS-PEG4-Azide, NHS-PEG12-Azide; each available from Thermo Fisher Scientific, Inc.), an NHS-Phosphine reagent (e.g., NHS-Phosphine, Sulfo-NHS-Phosphine; each available from Thermo Fisher Scientific, Inc.), or any combination or modification thereof.

A variety of methods can be used to disrupt the microvesicle. For example, the vesicle membrane can be disrupted using mechanical forces, chemical agents, or a combination thereof. In embodiments, disrupting the microvesicle comprises use of one or more of a detergent, a surfactant, a solvent, an enzyme, or any useful combination thereof. The enzyme may comprise one or more of lysozyme, lysostaphin, zymolase, cellulase, mutanolysin, a glycanase, a protease, and mannase. The detergent or surfactant may comprise one or more of a octylthioglucoside (OTG), octyl beta-glucoside (OG), a nonionic detergent, Triton X, Tween 20, a fatty alcohol, a cetyl alcohol, a stearyl alcohol, cetostearyl alcohol, an oleyl alcohol, a polyoxyethylene glycol alkyl ether (Brij), octaethylene glycol monododecyl ether, pentaethylene glycol monododecyl ether, a polyoxypropylene glycol alkyl ether, a glucoside alkyl ether, decyl glucoside, lauryl glucoside, octyl glucoside, a polyoxyethylene glycol octylphenol ethers, a polyoxyethylene glycol alkylphenol ether, nonoxynol-9, a glycerol alkyl ester, glyceryl laurate, a polyoxyethylene glycol sorbitan alkyl esters, polysorbate, a sorbitan alkyl ester, cocamide MEA, cocamide DEA, dodecyldimethylamine oxide, a block copolymers of polyethylene glycol and polypropylene glycol, poloxamers, polyethoxylated tallow amine (POEA), a zwitterionic detergent, 3-[(3-cholamidopropyl)dimethylammonio]-1-propanesulfonate (CHAPS), a linear alkylbenzene sulfonate (LAS), a alkyl phenol ethoxylate (APE), cocamidopropyl hydroxysultaine, a betaine, cocamidopropyl betaine, lecithin, an ionic detergent, sodium dodecyl sulfate (SDS), cetrimonium bromide (CTAB), cetyl trimethylammonium chloride (CTAC), octenidine dihydrochloride, cetylpyridinium chloride (CPC), benzalkonium chloride (BAC), benzethonium chloride (BZT), 5-Bromo-5-nitro-1,3-dioxane, dimethyldioctadecylammonium chloride, dioctadecyldimethylammonium bromide (DODAB), sodium deoxycholate, nonyl phenoxypolyethoxylethanol (Tergitol-type NP-40; NP-40), ammonium lauryl sulfate, sodium laureth sulfate (sodium lauryl ether sulfate (SLES)), sodium myreth sulfate, an alkyl carboxylate, sodium stearate, sodium lauroyl sarcosinate, a carboxylate-based fluorosurfactant, perfluorononanoate, perfluorooctanoate (PFOA or PFO), and a biosurfactant. Mechanical methods of disruption that can be used comprise without limitation mechanical shear, bead milling, homogenation, microfluidization, sonication, French Press, impingement, a colloid mill, decompression, osmotic shock, thermolysis, freeze-thaw, desiccation, or any combination thereof.

As shown in FIG. 9, the binding agent may be tethered to a substrate. The binding agent can be tethered before or after the complex between the binding agent and target is formed. The substrate can be any useful substrate such as disclosed herein or known in the art. In an embodiment, the substrate comprises a microsphere. In another embodiment, the substrate comprises a planar substrate. The binding agent can also be labeled. Isolating the complex between the target and the binding agent may comprise capturing the binding agent via the label. For example, the label can be a biotin label. In such cases, the binding agent can be attached to the substrate via a biotin-avidin binding event.

Methods of identifying the target after release from the binding agent will depend on the type of target of interest. For example, when the target comprises a protein, identifying the target may comprise use of mass spectrometry (MS), peptide mass fingerprinting (PMF; protein fingerprinting), sequencing, N-terminal amino acid analysis, C-terminal amino acid analysis, Edman degradation, chromatography, electrophoresis, two-dimensional gel electrophoresis (2D gel), antibody array, and immunoassay. Nucleic acids can be identified by sequencing.

One of skill will appreciate that the method can be used to identify any appropriate target, including those not associated with a vesicle. For example, with respect to the FIG. 9, all steps except for the step signified by arrow (i) (i.e., disrupting the microvesicle), could be performed for a circulating target such as a protein, nucleic acid, lipid, carbohydrate, or combination thereof. The target can be any useful target, including without limitation a cell, an organelle, a protein complex, a lipoprotein, a carbohydrate, a microvesicle, a virus, a membrane fragment, a small molecule, a heavy metal, a toxin, a drug, a nucleic acid, mRNA, microRNA, a protein-nucleic acid complex, and various combinations, fragments and/or complexes of any of these.

In an aspect, the invention provides a method of identifying at least one protein associated with at least one microvesicle in a biological sample, comprising: a) contacting the at least one microvesicle with an oligonucleotide probe library, b) isolating at least one protein bound by at least one member of the oligonucleotide probe library in step a); and c) identifying the at least one protein isolated in step b). The isolating can be performed using any useful method such as disclosed herein, e.g., by immunoprecipition or capture to a substrate. Similarly, the identifying can be performed using any useful method such as disclosed herein, including without limitation use of mass spectrometry, 2-D gel electrophoresis or an antibody array. Examples of such methodology are presented herein in Examples 23-25.

The targets identified by the methods of the invention can be detected, e.g., using the oligonucleotide probes of the invention, for various purposes as desired. For example, an identified microvesicle surface antigen can then be used to detect a microvesicle. In an aspect, the invention provides a method of detecting at least one microvesicle in a biological sample comprising contacting the biological sample with at least one binding agent to at least one microvesicle surface antigen and detecting the at least one microvesicle recognized by the binding agent to the at least one protein. In an embodiment, the at least one microvesicle surface antigen is selected from Tables 3-4 herein. The at least one microvesicle surface antigen can be a protein in any of Tables 18-25. See Example 23. The at least one binding agent may comprise any useful binding agent, including without limitation a nucleic acid, DNA molecule, RNA molecule, antibody, antibody fragment, aptamer, peptoid, zDNA, peptide nucleic acid (PNA), locked nucleic acid (LNA), lectin, peptide, dendrimer, membrane protein labeling agent, chemical compound, or a combination thereof. In some embodiments, the at least one binding agent comprises at least one oligonucleotide, such as an oligonucleotide probe as provided herein.

The at least one binding agent can be used to capture and/or detect the at least one microvesicle. Methods of detecting biomarkers and microvesicle using binding agents are provided herein. See, e.g., FIGS. 2A-B, which figures describe sandwich assay formats. In some embodiments, the at least one binding agent used to capture the at least one microvesicle is bound to a substrate. Any useful substrate can be used, including without limitation a planar array, a column matrix, or a microbead. See, e.g., FIGS. 2A-B. In some embodiments, the at least one binding agent used to detect the at least one microvesicle is labeled. Various useful labels are provided herein or known in the art, including without limitation a magnetic label, a fluorescent moiety, an enzyme, a chemiluminescent probe, a metal particle, a non-metal colloidal particle, a polymeric dye particle, a pigment molecule, a pigment particle, an electrochemically active species, a semiconductor nanocrystal, a nanoparticle, a quantum dot, a gold particle, a fluorophore, or a radioactive label.

In an embodiment, the detecting is used to characterize a phenotype. The phenotype can be any appropriate phenotype of interest. In some embodiments, the phenotype is a disease or disorder. The characterizing may comprise providing diagnostic, prognostic and/or theranostic information for the disease or disorder. The characterizing may be performed by comparing a presence or level of the at least one microvesicle to a reference. The reference can be selected per the characterizing to be performed. For example, when the phenotype comprises a disease or disorder, the reference may comprise a presence or level of the at least one microvesicle in a sample from an individual or group of individuals without the disease or disorder. The comparing can be determining whether the presence or level of the microvesicle differs from that of the reference. In some embodiments, the detected at least one microvesicle is found at higher levels in a healthy sample as compared to a diseased sample. In another embodiment, the detected at least one microvesicle is found at higher levels in a diseased sample as compared to a healthy sample. When multiplex assays are performed, e.g., using a plurality of binding agents to different biomarkers, some microvesicle antigens may be observed at a higher level in the biological samples as compared to the reference whereas other microvesicle antigens may be observed at a lower level in the biological samples as compared to the reference.

The method can be used to detect the at least one microvesicle in any appropriate biological sample. For example, the biological sample may comprise a bodily fluid, tissue sample or cell culture. The bodily fluid or tissue sample can be from a subject having or suspected of having a medical condition, a disease or a disorder. Thus, the method can be used to provide a diagnostic, prognostic, or theranostic read out for the subject. Any appropriate bodily fluid can be used, including without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair oil, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood.

The method of the invention can be used to detect or characterize any appropriate disease or disorder of interest, including without limitation Breast Cancer, Alzheimer's disease, bronchial asthma, Transitional cell carcinoma of the bladder, Giant cellular osteoblastoclastoma, Brain Tumor, Colorectal adenocarcinoma, Chronic obstructive pulmonary disease (COPD), Squamous cell carcinoma of the cervix, acute myocardial infarction (AMI)/acute heart failure, Chron's Disease, diabetes mellitus type II, Esophageal carcinoma, Squamous cell carcinoma of the larynx, Acute and chronic leukemia of the bone marrow, Lung carcinoma, Malignant lymphoma, Multiple Sclerosis, Ovarian carcinoma, Parkinson disease, Prostate adenocarcinoma, psoriasis, Rheumatoid Arthritis, Renal cell carcinoma, Squamous cell carcinoma of skin, Adenocarcinoma of the stomach, carcinoma of the thyroid gland, Testicular cancer, ulcerative colitis, or Uterine adenocarcinoma.

In some embodiments, the disease or disorder comprises a cancer, a premalignant condition, an inflammatory disease, an immune disease, an autoimmune disease or disorder, a cardiovascular disease or disorder, neurological disease or disorder, infectious disease or pain. The cancer can include without limitation one of acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sézary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenström macroglobulinemia; or Wilm's tumor. The premalignant condition can include without limitation Barrett's Esophagus. The autoimmune disease can include without limitation one of inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. The cardiovascular disease can include without limitation one of atherosclerosis, congestive heart failure, vulnerable plaque, stroke, ischemia, high blood pressure, stenosis, vessel occlusion or a thrombotic event. The neurological disease can include without limitation one of Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain can include without limitation one of fibromyalgia, chronic neuropathic pain, or peripheral neuropathic pain. The infectious disease can include without limitation one of a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, or influenza. One of skill will appreciate that oligonucleotide probes or plurality of oligonucleotides or methods of the invention can be used to assess any number of these or other related diseases and disorders.

In a related aspect, the invention provides a kit comprising a reagent for carrying out the methods herein. In still another related aspect, the invention provides for use of a reagent for carrying out the methods. The reagent may comprise at least one binding agent to the at least one protein. The binding agent may be an oligonucleotide probe as provided herein.

Sample Characterization

The aptamers of the invention can be used to characterize a biological sample. For example, an aptamer can be used to bind a biomarker in the sample. The presence or level of the bound biomarker can indicate a characteristic of the example, such as a diagnosis, prognosis or theranosis of a disease or disorder associated with the sample.

In an aspect, the invention provides an aptamer comprising a nucleic acid sequence that is at least about 50, 55, 60, 65, 70, 75, 80, 85, 90, 95, 96, 97, 98, 99 or 100 percent homologous of any of: a) SEQ ID NOs. 11-24 or a sequence in Table 8; a) SEQ ID NOs. 25-44 or a sequence in Table 11; b) SEQ ID NOs. 47-130 or a sequence in Table 12; or c) a functional variation or fragment of any preceding sequence. A functional variation or fragment includes a sequence comprising modifications that is still capable of binding a target molecule, wherein the modifications comprise without limitation at least one of a deletion, insertion, point mutation, truncation or chemical modification. In a related aspect, the invention provides a method of characterizing a disease or disorder, comprising: (a) contacting a biological test sample with one or more aptamer of the invention, e.g., any of those in this paragraph or modifications thereof; (b) detecting a presence or level of a complex between the one or more aptamer and the target bound by the one or more aptamer in the biological test sample formed in step (a); (c) contacting a biological control sample with the one or more aptamer; (d) detecting a presence or level of a complex between the one or more aptamer and the target bound by the one or more aptamer in the biological control sample formed in step (c); and (e) comparing the presence or level detected in steps (b) and (d), thereby characterizing the disease or disorder.

The biological test sample and biological control sample can each comprise a tissue sample, a cell culture, or a biological fluid. In some embodiments, the biological test sample and biological control sample comprise the same sample type, e.g., both are tissue samples or both are fluid samples. In other embodiments, different sample types may be used for the test and control samples. For example, the control sample may comprise an engineered or otherwise artificial sample.

The biological fluid may comprise a bodily fluid. The bodily fluid may include without limitation one or more of peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood. In some embodiments, the bodily fluid comprises blood, serum or plasma.

The biological fluid may comprise microvesicles. For example, the biological fluid can be a tissue, cell culture, or bodily fluid which comprises microvesicles released from cells in the sample. The microvesicles can be circulating microvesicles.

The one or more aptamer can bind a target biomarker, e.g., a biomarker useful in characterizing the sample. The biomarker may comprise a polypeptide or fragment thereof, or other useful biomarker described herein or known in the art (lipid, carbohydrate, complex, nucleic acid, etc). In embodiments, the polypeptide or fragment thereof is soluble or membrane bound. Membrane bound polypeptides may comprise a cellular surface antigen or a microvesicle surface antigen. The biomarker can be a biomarker selected from Table 3 or Table 4.

The characterizing can comprises a diagnosis, prognosis or theranosis of the disease or disorder. Various diseases and disorders can be characterized using the compositions and methods of the invention, including without limitation a cancer, a premalignant condition, an inflammatory disease, an immune disease, an autoimmune disease or disorder, a cardiovascular disease or disorder, a neurological disease or disorder, an infectious disease, and/or pain. See, e.g., section herein "Phenotypes" for further details. In embodiments, the disease or disorder comprises a proliferative or neoplastic disease or disorder. For example, the disease or disorder can be a cancer. In some embodiments, the cancer comprises a breast cancer, ovarian cancer, prostate cancer, lung cancer, colorectal cancer, melanoma, or brain cancer.

FIG. 19A is a schematic 1900 showing an assay configuration that can be used to detect and/or quantify a target of interest using one or more aptamer of the invention. Capture aptamer 1902 is attached to substrate 1901. The substrate can be a planar substrate, well, microbead, or other useful substrate as disclosed herein or known in the art. Target of interest 1903 is bound by capture aptamer 1902. The target of interest can be any appropriate entity that can be detected when recognized by an aptamer or other binding agent. The target of interest may comprise a protein or polypeptide, a nucleic acid, including DNA, RNA, and various subspecies thereof, a lipid, a carbohydrate, a complex, e.g., a complex comprising protein, nucleic acids, lipids and/or carbohydrates. In some embodiments, the target of interest comprises a microvesicle. The target of interest can be a microvesicle surface antigen. The target of interest may be a biomarker, including a vesicle associated biomarker, in Tables 3 or 4. The microvesicle input can be isolated from a sample using various techniques as described herein, e.g., chromatography, filtration, centrifugation, flow cytometry, affinity capture (e.g., to a planar surface, column or bead), and/or using microfluidics. Detection aptamer 1904 is also bound to target of interest 1903. Detection aptamer 1904 carries label 1905 which can be detected to identify target captured to substrate 1901 via capture aptamer 1902. The label can be a fluorescent, radiolabel, enzyme, or other detectable label as disclosed herein. Either capture aptamer 1902 or detection aptamer 1904 can be substituted with another binding agent, e.g., an antibody. For example, the target may be captured with an antibody and detected with an aptamer, or vice versa. When the target of interest comprises a complex, the capture and detection agents (aptamer, antibody, etc) can recognize the same or different targets. For example, when the target is a microvesicle, the capture agent may recognize one microvesicle surface antigen while the detection agent recognizes another microvesicle surface antigen. Alternately, the capture and detection agents can recognize the same surface antigen.

The aptamers of the invention may be identified and/or used for various purposes in the form of DNA or RNA. Unless otherwise specified, one of skill in the art will appreciate that an aptamer may generally be synthesized in various forms of nucleic acid. The aptamers may also carry various chemical modifications and remain within the scope of the invention.

In some embodiments, an aptamer of the invention is modified to comprise at least one chemical modification. The modification may include without limitation a chemical substitution at a sugar position; a chemical substitution at a phosphate position; and a chemical substitution at a base position of the nucleic acid. In some embodiments, the modification is selected from the group consisting of: biotinylation, incorporation of a fluorescent label, incorporation of a modified nucleotide, a 2'-modified pyrimidine, 3' capping, conjugation to an amine linker, conjugation to a high molecular weight, non-immunogenic compound, conjugation to a lipophilic compound, conjugation to a drug, conjugation to a cytotoxic moiety, and labeling with a radioisotope, or other modification as disclosed herein. The position of the modification can be varied as desired. For example, the biotinylation, fluorescent label, or cytotoxic moiety can be conjugated to the 5' end of the aptamer. The biotinylation, fluorescent label, or cytotoxic moiety can also be conjugated to the 3' end of the aptamer.

In some embodiments, the cytotoxic moiety is encapsulated in a nanoparticle. The nanoparticle can be selected from the group consisting of: liposomes, dendrimers, and comb polymers. In other embodiments, the cytotoxic moiety comprises a small molecule cytotoxic moiety. The small molecule cytotoxic moiety can include without limitation vinblastine hydrazide, calicheamicin, vinca alkaloid, a cryptophycin, a tubulysin, dolastatin-10, dolastatin-15, auristatin E, rhizoxin, epothilone B, epithilone D, taxoids, maytansinoids and any variants and derivatives thereof. In still other embodiments, the cytotoxic moiety comprises a protein toxin. For example, the protein toxin can be selected from the group consisting of diphtheria toxin, ricin, abrin, gelonin, and Pseudomonas exotoxin A. Non-immunogenic, high molecular weight compounds for use with the invention include polyalkylene glycols, e.g., polyethylene glycol. Appropriate radioisotopes include yttrium-90, indium-111, iodine-131, lutetium-177, copper-67, rhenium-186, rhenium-188, bismuth-212, bismuth-213, astatine-211, and actinium-225. The aptamer may be labeled with a gamma-emitting radioisotope.

In some embodiments of the invention, an active agent is conjugated to the aptamer. For example, the active agent may be a therapeutic agent or a diagnostic agent. The therapeutic agent may be selected from the group consisting of tyrosine kinase inhibitors, kinase inhibitors, biologically active agents, biological molecules, radionuclides, adriamycin, ansamycin antibiotics, asparaginase, bleomycin, busulphan, cisplatin, carboplatin, carmustine, capecotabine, chlorambucil, cytarabine, cyclophosphamide, camptothecin, dacarbazine, dactinomycin, daunorubicin, dexrazoxane, docetaxel, doxorubicin, etoposide, epothilones, floxuridine, fludarabine, fluorouracil, gemcitabine, hydroxyurea, idarubicin, ifosfamide, irinotecan, lomustine, mechlorethamine, mercaptopurine, melphalan, methotrexate, rapamycin (sirolimus), mitomycin, mitotane, mitoxantrone, nitrosurea, paclitaxel, pamidronate, pentostatin, plicamycin, procarbazine, rituximab, streptozocin, teniposide, thioguanine, thiotepa, taxanes, vinblastine, vincristine, vinorelbine, taxol, combretastatins, discodermolides, transplatinum, anti-vascular endothelial growth factor compounds ("anti-VEGFs"), anti-epidermal growth factor receptor compounds ("anti-EGFRs"), 5-fluorouracil and derivatives, radionuclides, polypeptide toxins, apoptosis inducers, therapy sensitizers, enzyme or active fragment thereof, and combinations thereof.

Oligonucleotide Pools to Characterize a Sample

Figure 20A:
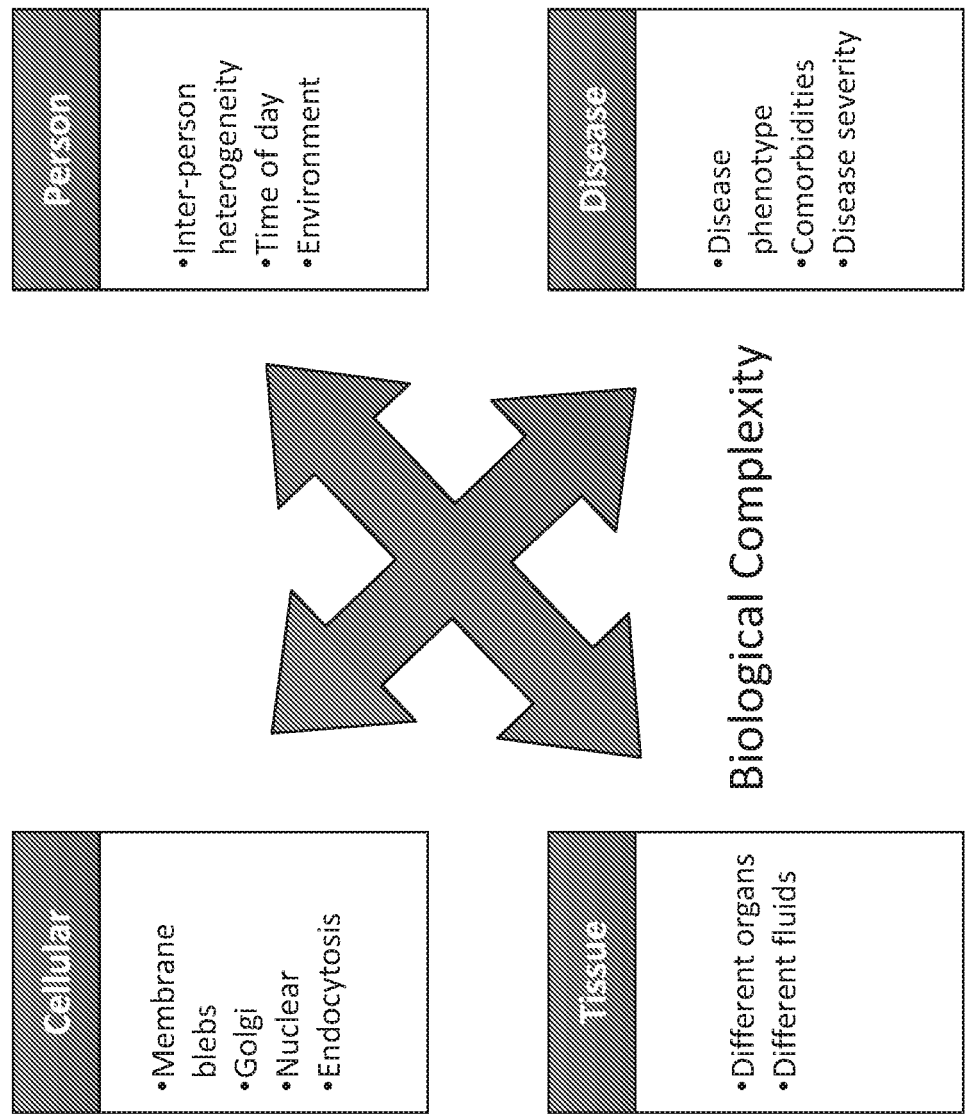
FIGS. 20A-I illustrate development and use of an oligonucleotide probe library to distinguish biological sample types.
Figure 20B:
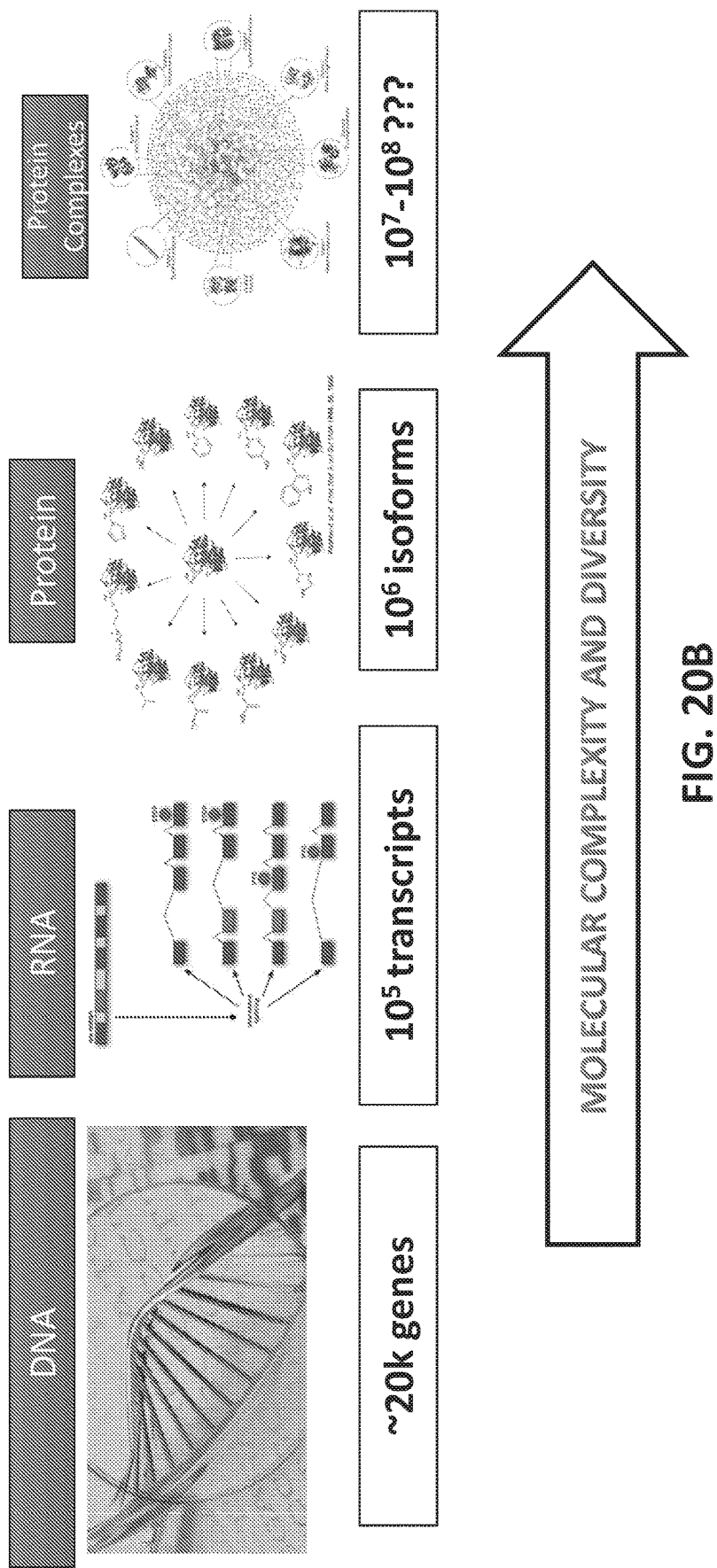

The complexity and heterogeneity present in biology challenges the understanding of biological systems and disease. Diversity exists at various levels, e.g., within and between cells, tissues, individuals and disease states. See, e.g., FIG. 20A. FIG. 20B overviews various biological entities that can be assessed to characterize such samples. As shown in the Figure, as one moves from assessing DNA, to RNA, to protein, and finally to protein complexes, the amount of diversity and complexity increases dramatically. The oligonucleotide probe library method of the invention can be used characterize complex biological sources, e.g., tissue samples, cells, circulating tumor cells, microvesicles, and complexes such as protein and proteolipid complexes.

Figure 20C:
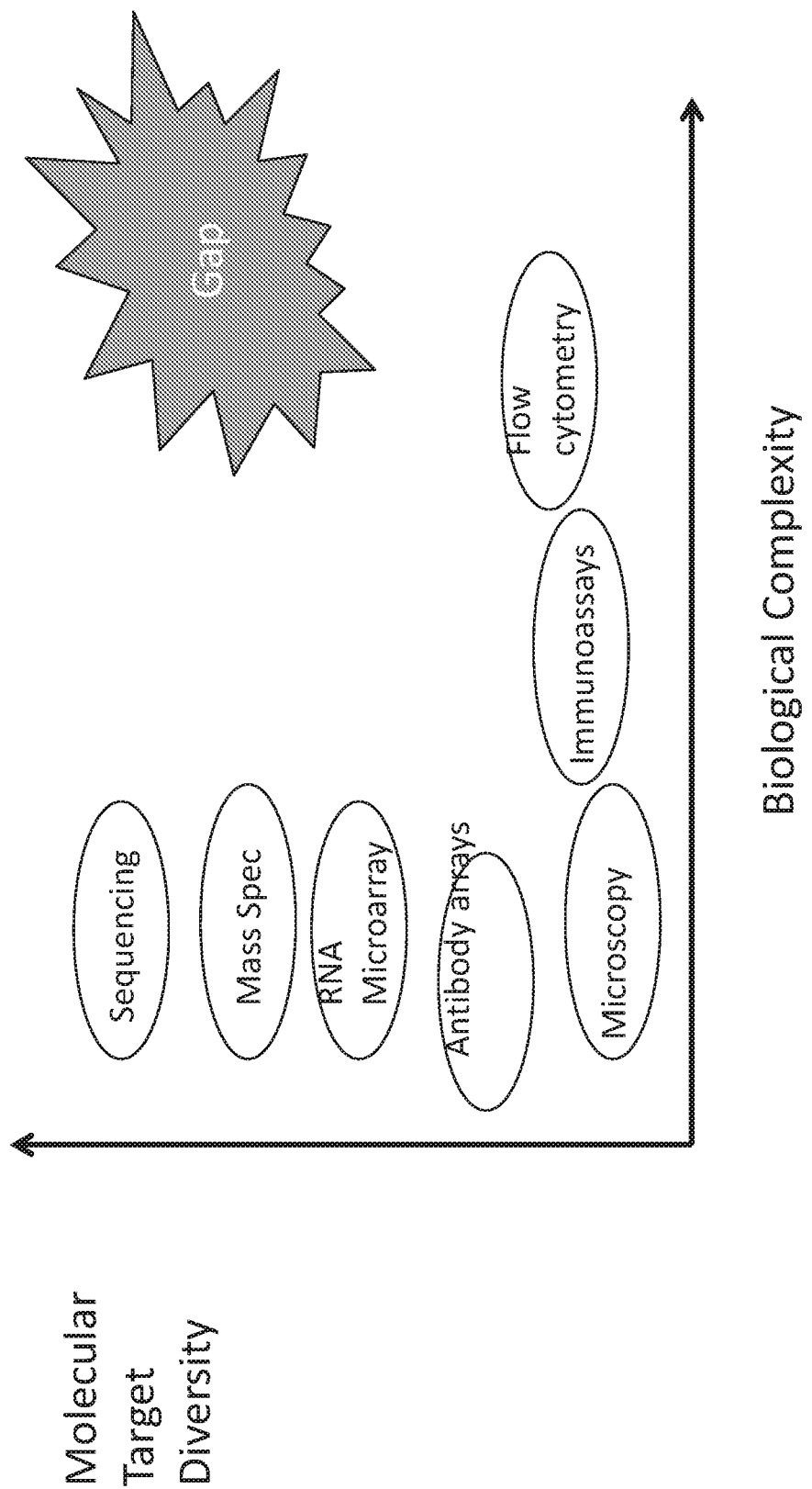

Current methods to characterize biological samples may not adequately address such complexity and diversity. As shown in FIG. 20C, such current methods often have a trade off between measuring diversity and complexity. As an example, consider high throughput sequencing technology. Next generation approaches may query many 1000s of molecular targets in a single assay. However, such approaches only probe individual DNA and/or RNA molecules, and thus miss out on the great diversity of proteins and biological complexes. On the other hand, flow cytometry can probe biological complexes, but are limited to a small number of pre-defined ligands. For example, a single assay can probe a handful of differentially labeled antibodies to pre-defined targets.

The oligonucleotide probe library of the invention address the above challenges with current biological detection technologies. The size of the starting library can be adjusted to measure as many different entities as there are library members. In this Example, the initial untrained oligonucleotide library has the potential to measure $10^{12}$ or more biological features. A larger and/or different library can be constructed as desired. The technology is adapted to find differences between samples without assumptions about what "should be different." For example, the probe library may distinguish based on individual proteins, protein modifications, protein complexes, lipids, nucleic acids, different folds or conformations, or whatever is there that distinguishes a sample of interest. Thus, the method provides an unbiased approach to identify differences in biological samples that can be used to identify different populations of interest.

In the context herein, the use of the oligonucleotide library probe to assess a sample may be referred to as Adaptive Dynamic Artificial Poly-ligand Targeting, or ADAPT™ (previously referred to as Topological Oligonucleotide Profiling: TOP™). Although as noted the terms aptamer and oligonucleotides are typically used interchangeable herein, some differences between "classic" individual aptamers and ADAPT probes are as follows. Individual aptamers may comprise individual oligonucleotides selected to bind to a known specific target in an antibody-like "key-in-lock" binding mode. They may be evaluated individually based on specificity and binding affinity to the intended target. However, ADAPT probes may comprise a library of oligonucleotides intended to produce multi-probe signatures. The ADAPT probes comprise numerous potential binding modalities (electrostatic, hydrophobic, Watson-Crick, multi-oligo complexes, etc.). The ADAPT probe signatures have the potential to identify heterogeneous patient subpopulations. For example, a single ADAPT probe library can be assembled to differentiate multiple disease states, as demonstrated herein. Unlike classic single aptamers, the binding targets may or may not be isolated or identified. It will be understood that screening methods that identify individual aptamers, e.g., SELEX, can also be used to enrich a naive library of oligonucleotides to identify a ADAPT probe library.

Figure 20D:
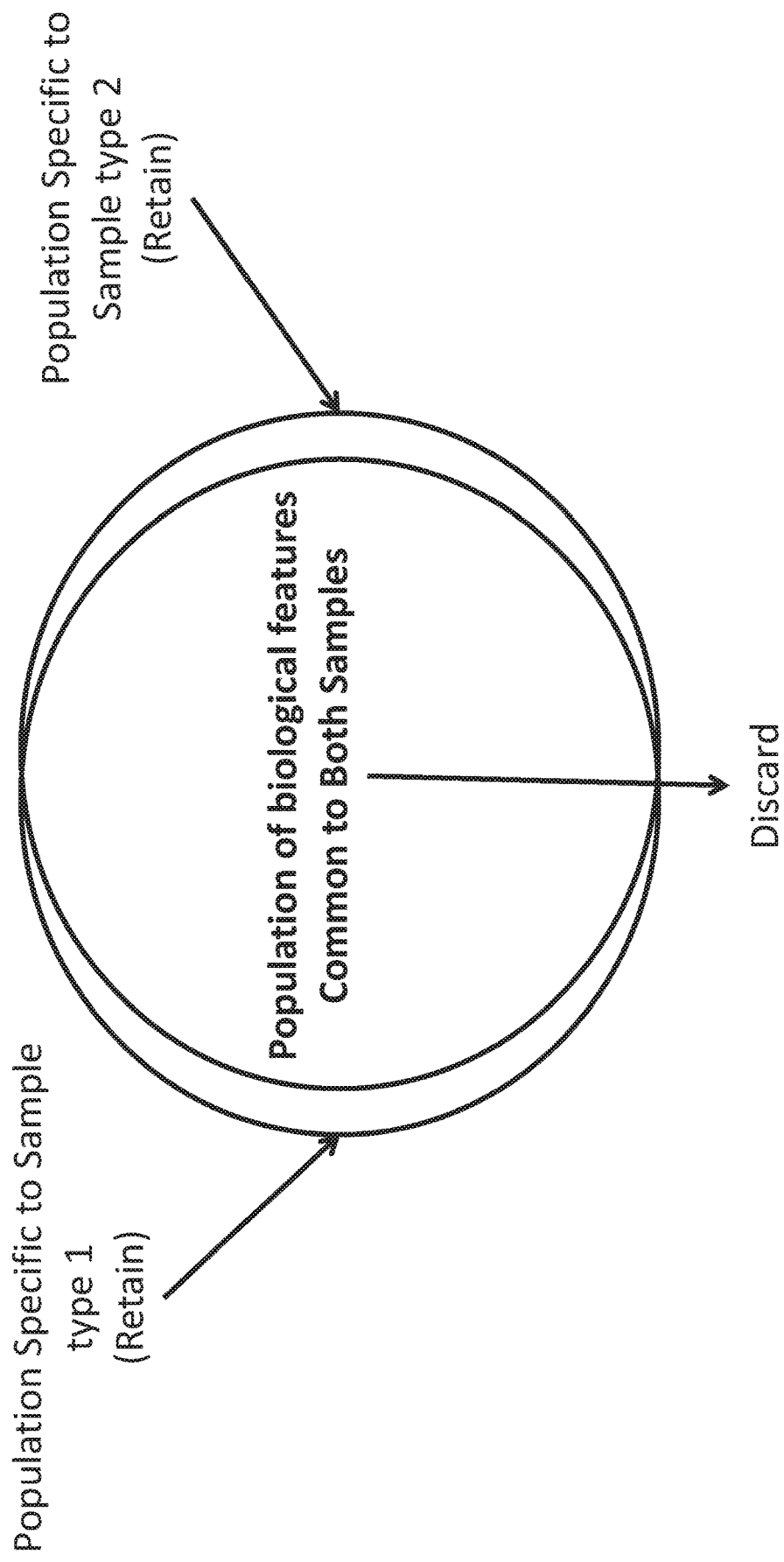

The general method of the invention is outlined in FIG. 20D. One input to the method comprises a randomized oligonucleotide library with the potential to measure $10^{12}$ or more biological features. As outlined in the figure, the method identifies a desired number (e.g., ~$10^5$-$10^6$) that are different between two input sample types. The randomized oligonucleotide library is contacted with a first and a second sample type, and oligonucleotides that bind to each sample are identified. The bound oligonucleotide populations are compared and oligonucleotides that specifically bind to one or the other biological input sample are retained for the oligonucleotide probe library, whereas oligonucleotides that bind both biological input samples are discarded. This trained oligonucleotide probe library can then be contacted with a new test sample and the identities of oligonucleotides that bind the test sample are determined. The test sample is characterized based on the profile of oligonucleotides that bound. See, e.g., FIG. 20H.

Figure 20E:
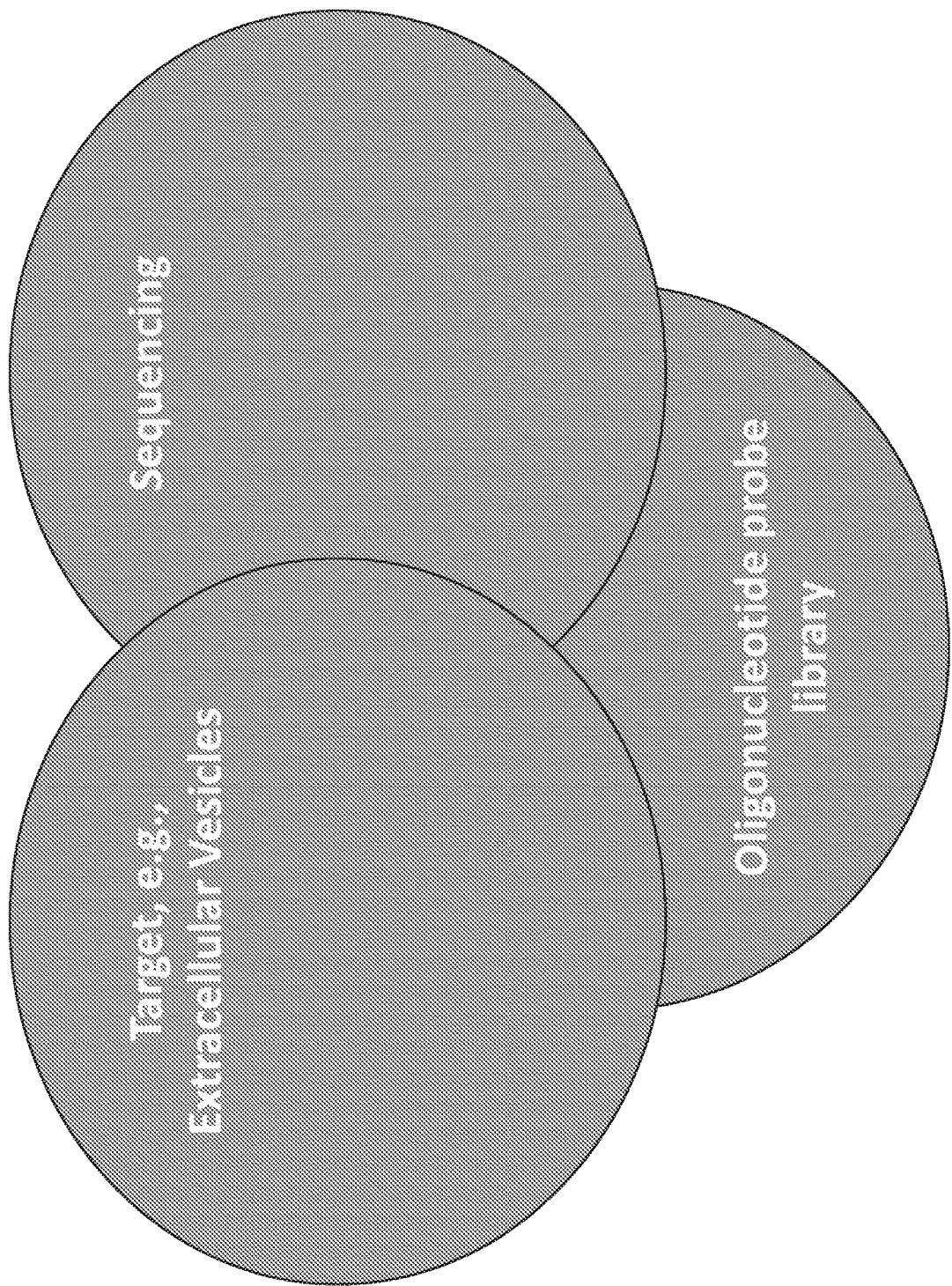

Extracellular vesicles provide an attractive vehicle to profile the biological complexity and diversity driven by many inter-related sources. There can be a great deal of heterogeneity between patient-to-patient microvesicle populations, or even in microvesicle populations from a single patient under different conditions (e.g., stress, diet, exercise, rest, disease, etc). Diversity of molecular phenotypes within microvesicle populations in various disease states, even after microvesicle isolation and sorting by vesicle biomarkers, can present challenges identifying surface binding ligands. This situation is further complicated by vesicle surface-membrane protein complexes. The oligonucleotide probe library can be used to address such challenges and allow for characterization of biological phenotypes. The approach combines the power of diverse oligonucleotide libraries and high throuput (next-generation) sequencing technologies to probe the complexity of extracellular microvesicles. See FIG. 20E.

Figure 20F:
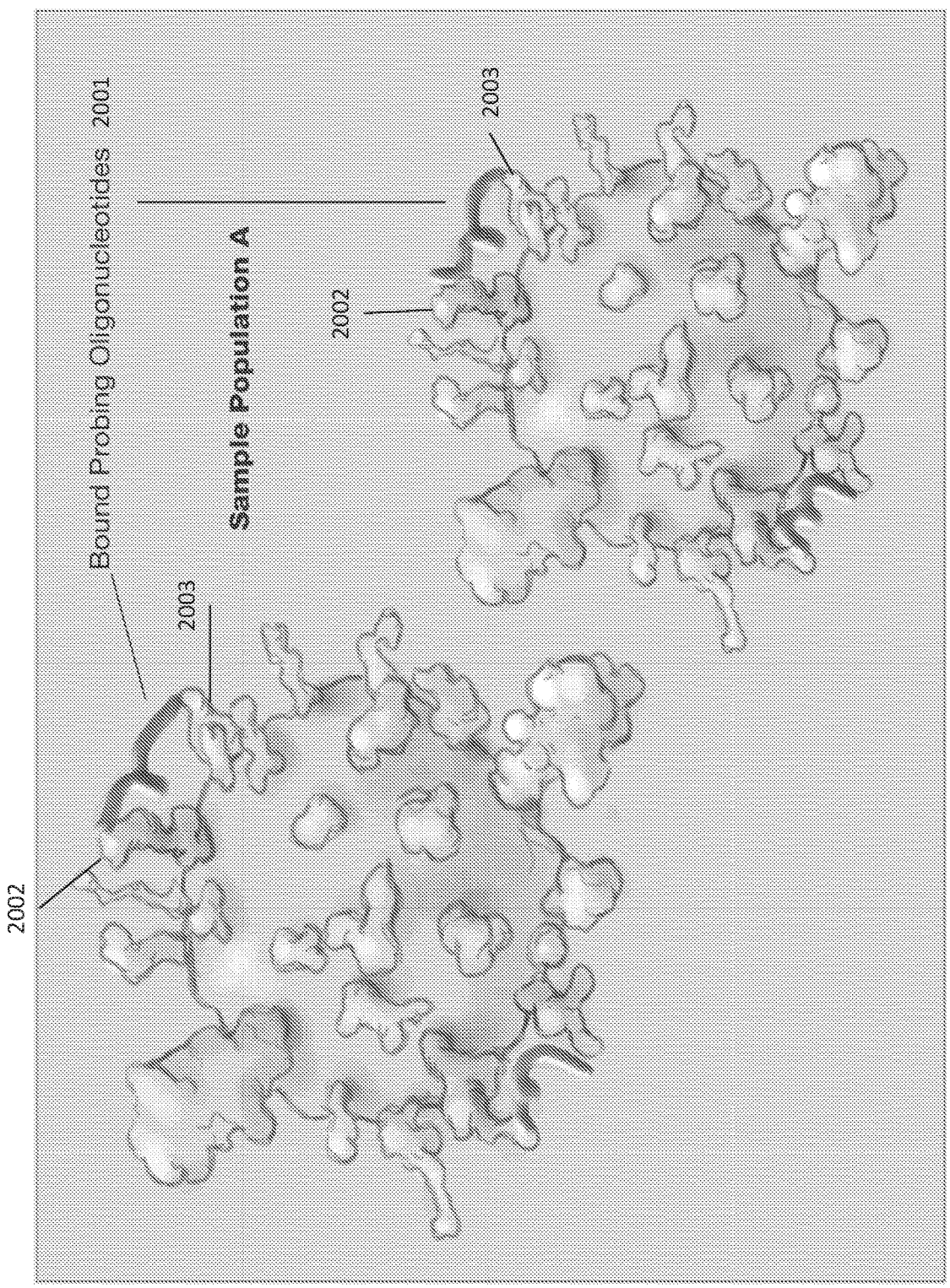
Figure 20G:
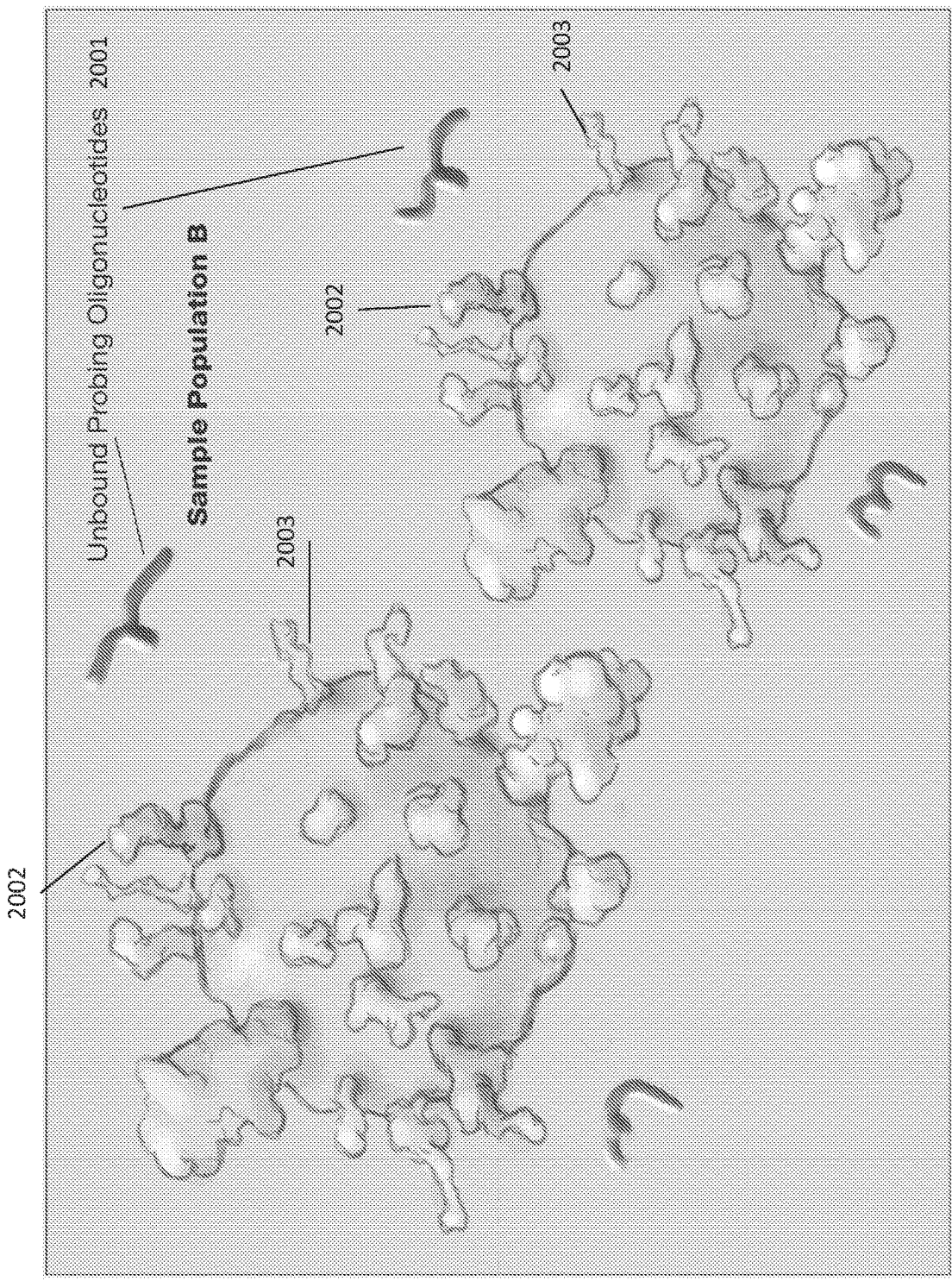

ADAPT™ profiling may provide quantitative measurements of dynamic events in addition to detection of presence/absence of various biomarkers in a sample. For example, the binding probes may detect protein complexes or other post-translation modifications, allowing for differentiation of samples with the same proteins but in different biological configurations. Such configurations are illustrated in FIGS. 20F-G. In FIG. 20F, microvesicles with various surface markers are shown from an example microvesicle sample population: Sample Population A. The indicated Bound Probing Oligonucleotides 2001 are contacted to two surface markers 2002 and 2003 in a given special relationship. Here, probes unique to these functional complexes and spatial relationships may be retained. In contrast, in microvesicle Sample Population B shown in FIG. 20F, the two surface markers 2002 and 2003 are found in disparate spacial relationship. Here, probes 2001 are not bound due to absence of the spatial relationship of the interacting components 2002 and 2003.

Figure 20H:
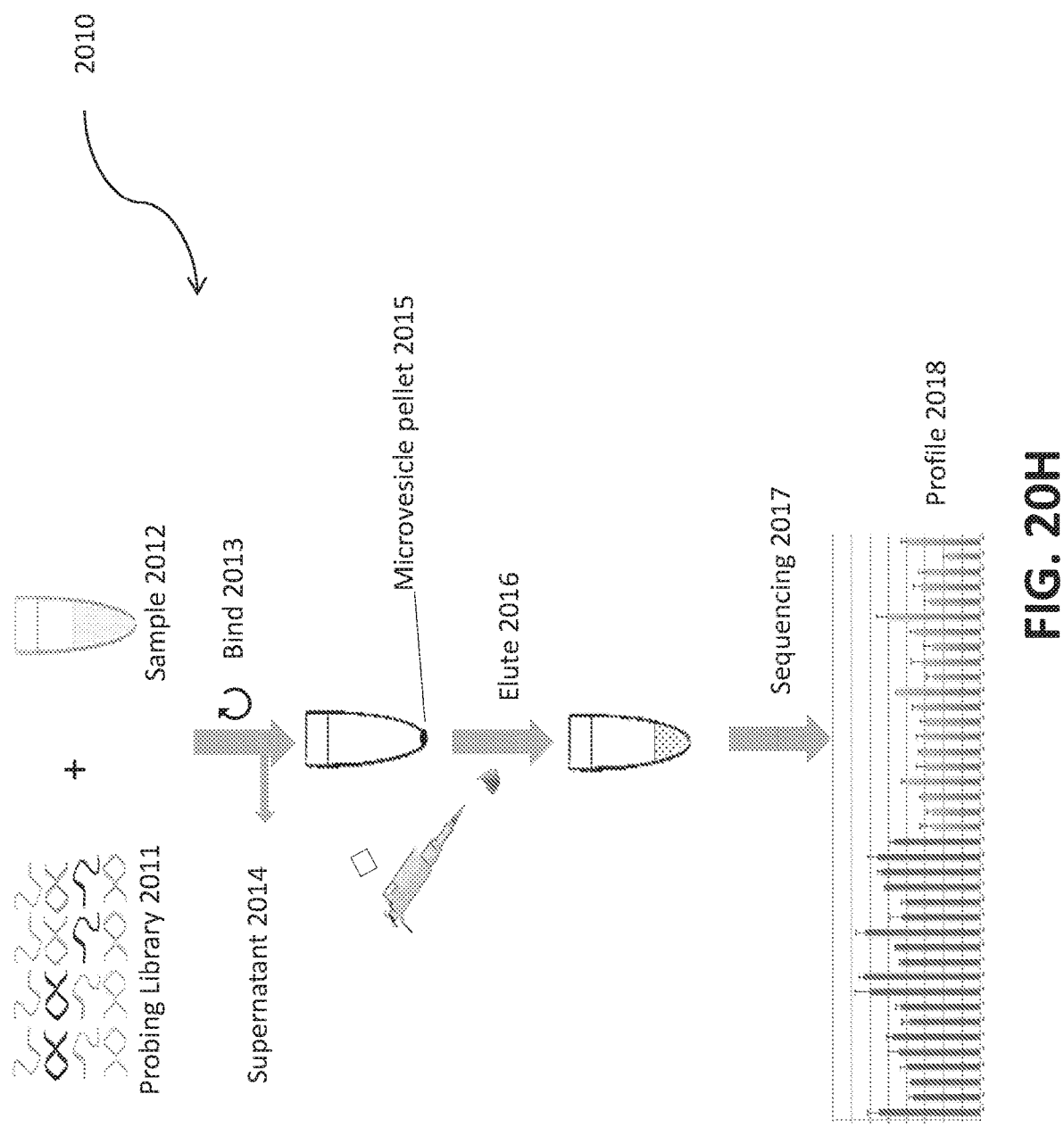
Figure 20I:
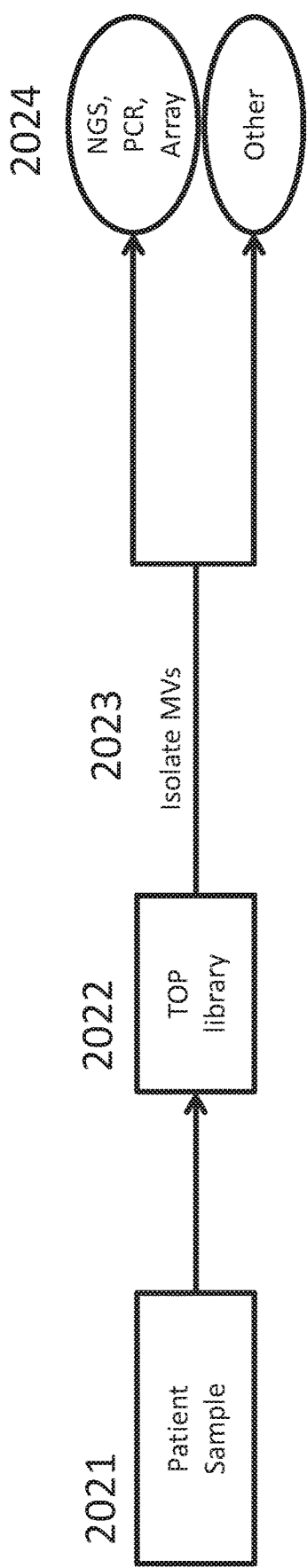

An illustrative approach 2010 for using ADAPT profiling to assess a sample is shown in FIG. 20H. The probing library 2011 is mixed with sample 2012. The sample can be as described herein, e.g., a bodily fluid from a subject having or suspected of having a disease. The probes are allowed to bind the sample 2020 and the microvesicles are pelleted 2015. The supernatant 2014 comprising unbound oligonucleotides is discarded. Oligonucleotide probes bound to the pellet 2015 are eluted 2016 and sequenced 2017. The profile 2018 generated by the bound oligonucleotide probes as determined by the sequencing 2017 is used to characterize the sample 2012. For example, the profile 2018 can be compared to a reference, e.g., to determine if the profile is similar or different from a reference profile indicative of a disease or healthy state, or other phenotypic characterization of interest. The comparison may indicate the presence of a disease, provide a diagnosis, prognosis or theranosis, or otherwise characterize a phenotype associated with the sample 2012. FIG. 20I illustrates another schematic for using TOP™ profiling to characterize a phenotype. A patient sample such as a bodily fluid disclosed herein is collected 2021. The sample is contacted with the ADAPT™ library pool 2022. Microvesicles (MVs) are isolated from the contacted sample 2023, e.g., using ultracentrifugation, filtration, polymer precipitation or other appropriate technique or combination of techniques disclosed herein. Oligonucleotides that bound the isolated microvesicles are collected and identity is determined 2024. The identity of the bound oligonucleotides can be determined by any useful technique such as sequencing, high throughput sequencing (e.g., NGS), amplification including without limitation qPCR, or hybridization such as to a planar or particle based array. The identity of the bound oligonucleotides is used to characterize the sample, e.g., as containing disease related microvesicles.

In an aspect, the invention provides a method of characterizing a sample by contacting the sample with a pool of different oligonucleotides (e.g., an aptamer pool), and determining the frequency at which various oligonucleotides in the pool bind the sample. For example, a pool of oligonucleotides is identified that preferentially bind to microvesicles from cancer patients as compared to non-cancer patients. A test sample, e.g., from a patient suspected of having the cancer, is collected and contacted with the pool of oligonucleotides. Oligonucleotides that bind the test sample are eluted from the test sample, collected and identified, and the composition of the bound oligonucleotides is compared to those known to bind cancer samples. Various sequencing, amplification and hybridization techniques can be used to identify the eluted oligonucleotides. For example, when a large pool of oligonucleotides is used, oligonucleotide identification can be performed by high throughput methods such as next generation sequencing or via hybridization. If the test sample is bound by the oligonucleotide pool in a similar manner (e.g., as determined by bioinformatics classification methods) to the microvesicles from cancer patients, then the test sample is indicative of cancer as well. Using this method, a pool of oligonucleotides that bind one or more microvesicle antigen can be used to characterize the sample without necessarily knowing the precise target of each member of the pool of oligonucleotides. Examples 26-30 and others herein illustrate embodiments of the invention.

In an aspect, the invention provides a method for characterizing a condition for a test sample comprising: contacting a microvesicle sample with a plurality of oligonucleotide capable of binding one or more target(s) present in said microvesicle sample, identifying a set of oligonucleotides that form a complex with the sample wherein the set is predetermined to characterize a condition for the sample, thereby characterizing a condition for a sample.

In an related aspect, the invention provides a method for identifying a set of oligonucleotides associated with a test sample, comprising: (a) contacting a microvesicle sample with a plurality of oligonucleotides, isolating a set of oligonucleotides that form a complex with the microvesicle sample, (b) determining sequence and/or copy number for each of the oligonucleotides, thereby identifying a set of oligonucleotides associated with the test sample.

In still another related aspect, the invention provides a method of diagnosing a sample as cancerous or predisposed to be cancerous, comprising contacting a microvesicle sample with a plurality of oligonucleotides that are predetermined to preferentially form a complex with microvesicles from a cancer sample as compared to microvesicles from a non-cancer sample.

The oligonucleotides can be identified by sequencing, e.g., by dye termination (Sanger) sequencing or high throughput methods. High throughput methods can comprise techniques to rapidly sequence a large number of nucleic acids, including next generation techniques such as Massively parallel signature sequencing (MPSS; Polony sequencing; 454 pyrosequencing; Illumina (Solexa) sequencing; SOLiD sequencing; Ion Torrent semiconductor sequencing; DNA nanoball sequencing; Heliscope single molecule sequencing; Single molecule real time (SMRT) sequencing, or other methods such as Nanopore DNA sequencing; Tunneling currents DNA sequencing; Sequencing by hybridization; Sequencing with mass spectrometry; Microfluidic Sanger sequencing; Microscopy-based techniques; RNAP sequencing; In vitro virus high-throughput sequencing. The oligonucleotides may also be identified by hybridization techniques. For example, a microarray having addressable locals to hybridize and thereby detect the various members of the pool can be used. Alternately, detection can be based on one or more differentially labelled oligonucleotides that hybridize with various members of the oligonucleotide pool. The detectable signal of the label can be associated with a nucleic acid molecule that hybridizes with a stretch of nucleic acids present in various oligonucleotides. The stretch can be the same or different as to one or more oligonucleotides in a library. The detectable signal can comprise fluorescence agents, including color-coded barcodes which are known, such as in U.S. Patent Application Pub. No. 20140371088, 2013017837, and 20120258870. Other detectable labels (metals, radioisotopes, etc) can be used as desired.

The plurality or pool of oligonucleotides can comprise any desired number of oligonucleotides to allow characterization of the sample. In various embodiments, the pool comprises at least 2, 3, 4, 5, 6, 7, 8, 9, 10, 11, 12, 13, 14, 15, 16, 17, 18, 19, 20, 25, 30, 40, 50, 60, 70, 80, 90, 100, 150, 200, 250, 300, 350, 400, 450, 500, 600, 700, 800, 900, 1000, 2000, 3000, 4000, 5000, 6000, 7000, 8000, 9000, or at least 10000 different oligonucleotide members.

The plurality of oligonucleotides can be pre-selected through one or more steps of positive or negative selection, wherein positive selection comprises selection of oligonucleotides against a sample having substantially similar characteristics compared to the test sample, and wherein negative selection comprises selection of oligonucleotides against a sample having substantially different characteristics compared to the test sample. Substantially similar characteristics mean that the samples used for positive selection are representative of the test sample in one or more characteristic of interest. For example, the samples used for positive selection can be from cancer patients or cell lines and the test sample can be a sample from a patient having or suspected to have a cancer. Substantially different characteristics mean that the samples used for negative selection differ from the test sample in one or more characteristic of interest. For example, the samples used for negative selection can be from individuals or cell lines that do not have cancer (e.g., "normal" or otherwise "control" samples) and the test sample can be a sample from a patient having or suspected to have a cancer. The cancer can be a breast cancer, ovarian cancer, prostate cancer, lung cancer, colorectal cancer, melanoma, brain cancer, or other cancer.

By selecting samples representative of the desired phenotypes to detect and/or distinguish, the characterizing can comprise a diagnosis, prognosis or theranosis for any number of diseases or disorders. Various diseases and disorders can be characterized using the compositions and methods of the invention, including without limitation a cancer, a pre-malignant condition, an inflammatory disease, an immune disease, an autoimmune disease or disorder, a cardiovascular disease or disorder, a neurological disease or disorder, an infectious disease, and/or pain. See, e.g., section herein "Phenotypes" for further details. In embodiments, the disease or disorder comprises a proliferative or neoplastic disease or disorder. For example, the disease or disorder can be a cancer. In some embodiments, the cancer comprises a breast cancer, ovarian cancer, prostate cancer, lung cancer, colorectal cancer, melanoma, or brain cancer.

FIG. 19B is a schematic 1910 showing use of an oligonucleotide pool to characterize a phenotype of a sample, such as those listed above. A pool of oligonucleotides to a target of interest is provided 1911. For example, the pool of oligonucleotides can be enriched to target one or more microvesicle. The members of the pool may bind different targets (e.g., a microvesicle surface antigen) or different epitopes of the same target present on the one or more microvesicle. The pool is contacted with a test sample to be characterized 1912. For example, the test sample may be a biological sample from an individual having or suspected of having a given disease or disorder. The mixture is washed to remove unbound oligonucleotides. The remaining oligonucleotides are eluted or otherwise disassociated from the sample and collected 1913. The collected oligonucleotides are identified, e.g., by sequencing or hybridization 1914. The presence and/or copy number of the identified is used to characterize the phenotype 1915. For example, the pool of oligonucleotides may be chosen as oligonucleotides that preferentially recognize microvesicles shed from cancer cells. The method can be employed to detect whether the sample retains oligonucleotides that bind the cancer-related microvesicles, thereby allowing the sample to be characterized as cancerous or not.

FIG. 19C is a schematic 1920 showing an implementation of the method in FIG. 19B. A pool of oligonucleotides identified as binding a microvesicle population is provided 1919. The input sample comprises a test sample comprising microvesicles 1922. For example, the test sample may be a biological sample from an individual having or suspected of having a given disease or disorder. The pool is contacted with the isolated microvesicles to be characterized 1923. The microvesicle population can be isolated before or after the contacting 1923 from the sample using various techniques as described herein, e.g., chromatography, filtration, ultrafiltration, centrifugation, ultracentrifugation, flow cytometry, affinity capture (e.g., to a planar surface, column or bead), polymer precipitation, and/or using microfluidics. The mixture is washed to remove unbound oligonucleotides and the remaining oligonucleotides are eluted or otherwise disassociated from the sample and collected 1924. The collected oligonucleotides are identified 1925 and the presence and/or copy number of the retained oligonucleotides is used to characterize the phenotype 1926 as above.

As noted, in embodiment of FIG. 19C, the pool of oligonucleotides 1919 is directly contacted with a biological sample that comprises or is expected to comprise microvesicles. Microvesicles are thereafter isolated from the sample and the mixture is washed to remove unbound oligonucleotides and the remaining oligonucleotides are disassociated and collected 1924. The following steps are performed as above. As an example of this alternate configuration, a biological sample, e.g., a blood, serum or plasma sample, is directly contacted with the pool of oligonucleotides. Microvesicles are then isolated by various techniques disclosed herein, including without limitation ultracentrifugation, ultrafiltration, flow cytometry, affinity isolation, polymer precipitation, chromatography, various combinations thereof, or the like. Remaining oligonucleotides are then identified, e.g., by sequencing, hybridization or amplification.

In a related aspect, the invention provides a composition of matter comprising a plurality of oligonucleotides that can be used to carry out the methods comprising use of an oligonucleotide pool to characterize a phenotype. The plurality of oligonucleotides can comprise any of those described herein.

In a related aspect, the invention provides a method of performing high-throughput sequencing comprising: performing at least one (i) negative selection or (ii) one positive selection of a plurality of oligonucleotides with a microvesicle sample; obtaining a set of oligonucleotides to provide a negative binder subset or positive binder subset of the plurality of oligonucleotides, wherein the negative binder subset of the plurality of oligonucleotides does not bind the microvesicle sample and wherein the positive binder subset of the plurality of oligonucleotides does bind the microvesicle sample; contacting the negative binder subset or positive binder subset with a test sample; eluting oligonucleotides that bound to the test sample to provide a plurality of eluate oligonucleotides; and performing high-throughput sequencing of the plurality of eluate oligonucleotides to identify sequence and/or copy number of the members of the plurality of eluate oligonucleotides. Negative and positive selection of the plurality of oligonucleotides using microvesicle sample can be performed as disclosed herein. The oligonucleotide profile revealed by the sequence and/or copy number of the members of the plurality of eluate oligonucleotides can be used to characterize a phenotype of the test sample as described herein.

In a similar aspect, the invention provides a method for identifying oligonucleotides specific for a test sample. The method comprises: (a) enriching a plurality of oligonucleotides for a sample to provide a set of oligonucleotides predetermined to form a complex with a target sample; (b) contacting the plurality in (a) with a test sample to allow formation of complexes of oligonucleotides with test sample; (c) recovering oligonucleotides that formed complexes in (b) to provide a recovered subset of oligonucleotides; and (d) profiling the recovered subset of oligonucleotides by high-throughput sequencing or hybridization, thereby identifying oligonucleotides specific for a test sample. The test sample may comprise a plurality of microvesicles. The oligonucleotides may comprise RNA, DNA or both. In some embodiment, the method further comprises performing informatics analysis to identify a subset of oligonucleotides comprising sequence identity of at least 50%, 55%, 60%, 65%, 70%, 75%, 80%, 85%, 90%, 91%, 92%, 93%, 94%, 95%, 96%, 97%, 98%, or at least 99% to the oligonucleotides predetermined to form a complex with the target sample.

One of skill will appreciate that the method can be used to identify any appropriate target, including those not associated with a microvesicle. The target can be any useful target, including without limitation a cell, an organelle, a protein complex, a lipoprotein, a carbohydrate, a microvesicle, a virus, a membrane fragment, a small molecule, a heavy metal, a toxin, a drug, a nucleic acid (including without limitation microRNA (miR) and messenger RNA (mRNA)), a protein-nucleic acid complex, and various combinations, fragments and/or complexes of any of these. The target can, e.g., comprise a mixture of microvesicles and non-microvesicle entities.

In an aspect, the invention also provides a method comprising contacting an oligonucleotide or plurality of oligonucleotides with a sample and detecting the presence or level of binding of the oligonucleotide or plurality of oligonucleotides to a target in the sample, wherein the oligonucleotide or plurality of oligonucleotides can be those provided by the invention above. The sample may comprise a biological sample, an organic sample, an inorganic sample, a tissue, a cell culture, a bodily fluid, blood, serum, a cell, a microvesicle, a protein complex, a lipid complex, a carbohydrate, or any combination, fraction or variation thereof. The target may comprise a cell, an organelle, a protein complex, a lipoprotein, a carbohydrate, a microvesicle, membrane fragment, a small molecule, a heavy metal, a toxin, or a drug.

In a related aspect, the invention provides a method comprising: a) contacting a biological sample comprising microvesicles with an oligonucleotide probe library, wherein optionally the oligonucleotide probe library comprises an oligonucleotide or plurality of oligonucleotides those provided by the invention above; b) identifying oligonucleotides bound to at least a portion of the microvesicles; and c) characterizing the sample based on a profile of the identified oligonucleotides.

In another aspect, the invention provides a method comprising: a) contacting a sample with an oligonucleotide probe library comprising at least $10^6$, $10^7$, $10^8$, $10^9$, $10^{10}$, $10^{11}$, $10^{12}$, $10^{13}$, $10^{14}$, $10^{15}$, $10^{16}$, $10^{17}$, or at least $10^{18}$ different oligonucleotide sequences oligonucleotides to form a mixture in solution, wherein the oligonucleotides are capable of binding a plurality of entities in the sample to form complexes, wherein optionally the oligonucleotide probe library comprises an oligonucleotide or plurality of oligonucleotides as provided by the invention above; b) partitioning the complexes formed in step (a) from the mixture; and c) detecting oligonucleotides present in the complexes partitioned in step (b) to identify an oligonucleotide profile for the sample. In an embodiment, the detecting step comprises performing sequencing of all or some of the oligonucleotides in the complexes, amplification of all or some of the oligonucleotides in the complexes, and/or hybridization of all or some of the oligonucleotides in the complexes to an array. The array can be any useful array, such as a planar or particle-based array.

In still another aspect, the invention provides a method for generating an enriched oligonucleotide probe library comprising: a) contacting a first oligonucleotide library with a biological test sample and a biological control sample, wherein complexes are formed between biological entities present in the biological samples and a plurality of oligonucleotides present in the first oligonucleotide library; b) partitioning the complexes formed in step (a) and isolating the oligonucleotides in the complexes to produce a subset of oligonucleotides for each of the biological test sample and biological control sample; c) contacting the subsets of oligonucleotides in (b) with the biological test sample and biological control sample wherein complexes are formed between biological entities present in the biological samples and a second plurality of oligonucleotides present in the subsets of oligonucleotides to generate a second subset group of oligonucleotides; and d) optionally repeating steps b)-c), one, two, three or more times to produce a respective third, fourth, fifth or more subset group of oligonucleotides, thereby producing the enriched oligonucleotide probe library. In a related aspect, the invention provides a plurality of oligonucleotides comprising at least 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 200000, 300000, 400000, or 500000 different oligonucleotide sequences, wherein the plurality results from the method in this paragraph, wherein the library is capable of distinguishing a first phenotype from a second phenotype. In some embodiments, the first phenotype comprises a disease or disorder and the second phenotype comprises a healthy state; or wherein the first phenotype comprises a disease or disorder and the second phenotype comprises a different disease or disorder; or wherein the first phenotype comprises a stage or progression of a disease or disorder and the second phenotype comprises a different stage or progression of the same disease or disorder; or wherein the first phenotype comprises a positive response to a therapy and the second phenotype comprises a negative response to the same therapy.

In yet another aspect, the invention provides a method of characterizing a disease or disorder, comprising: a) contacting a biological test sample with the oligonucleotide or plurality of oligonucleotides provided by the invention; b) detecting a presence or level of complexes formed in step (a) between the oligonucleotide or plurality of oligonucleotides provided by the invention and a target in the biological test sample; and c) comparing the presence or level detected in step (b) to a reference level from a biological control sample, thereby characterizing the disease or disorder. The step of detecting may comprise performing sequencing of all or some of the oligonucleotides in the complexes, amplification of all or some of the oligonucleotides in the complexes, and/or hybridization of all or some of the oligonucleotides in the complexes to an array. The sequencing may be high-throughput or next generation sequencing.

In the methods of the invention, the biological test sample and biological control sample may each comprise a tissue sample, a cell culture, or a biological fluid. In some embodiments, the biological fluid comprises a bodily fluid. Useful bodily fluids within the method of the invention comprise peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood. In some preferred embodiments, the bodily fluid comprises blood, serum or plasma. The biological fluid may comprise microvesicles. In such case, the complexes may be formed between the oligonucleotide or plurality of oligonucleotides and at least one of the microvesicles.

The biological test sample and biological control sample may further comprise isolated microvesicles, wherein optionally the microvesicles are isolated using at least one of chromatography, filtration, ultrafiltration, centrifugation, ultracentrifugation, flow cytometry, affinity capture (e.g., to a planar surface, column or bead), polymer precipitation, and using microfluidics. The vesicles can also be isolated after contact with the oligonucleotide or plurality of oligonucleotides.

In various embodiments of the methods of the invention, the oligonucleotide or plurality of oligonucleotides binds a polypeptide or fragment thereof. The polypeptide or fragment thereof can be soluble or membrane bound, wherein optionally the membrane comprises a microvesicle membrane. The membrane could also be from a cell or a fragment of a cell of vesicle. In some embodiments, the polypeptide or fragment thereof comprises a biomarker in Table 3, Table 4 or any one of Tables 18-25. For example, the polypeptide or fragment thereof could be a general vesicle marker such as in Table 3 or a tissue-related or disease-related marker such as in Table 4, or a vesicle associated biomarker provided in any one of Tables 18-25. The oligonucleotide or plurality of oligonucleotides may bind a microvesicle surface antigen in the biological sample. For example, the oligonucleotide or plurality of oligonucleotides can be enriched from a naïve library against microvesicles.

As noted above, the microvesicles may be isolated in whole or in part using polymer precipitation. In an embodiment, the polymer comprises polyethylene glycol (PEG). Any appropriate form of PEG may be used. For example, the PEG may be PEG 8000. The PEG may be used at any appropriate concentration. For example, the PEG can be used at a concentration of 1%, 2%, 3%, 4%, 5%, 6%, 7%, 8%, 9%, 10%, 11%, 12%, 13%, 14% or 15% to isolate the microvesicles. In some embodiments, the PEG is used at a concentration of 6%.

The invention provides oligonucleotide probes that can be used to carry out the methods herein. See, e.g., Examples 26-32. In an aspect, the invention provides an oligonucleotide comprising a sequence according to any one of SEQ ID NOs 137-969 and 1072-4150. In a related aspect, the invention provides an oligonucleotide comprising a sequence according to any one of the SEQ ID NOs in Table 40. In another related aspect, the invention provides an oligonucleotide comprising a sequence according to any one of the SEQ ID NOs in the row "2000v1" in Table 43. In still another related aspect, the invention provides an oligonucleotide comprising a sequence according to any one of the SEQ ID NOs in the row "2000v2" in Table 43. In yet another related aspect, the invention provides an oligonucleotide comprising a sequence according to any one of the SEQ ID NOs in the row "Common" in Table 43.

The oligonucleotides of the invention can comprise flanking regions for various purposes, including without limitation amplification, capture, conjugation or spacing. For example, the invention provides an oligonucleotide comprising a sequence according to any one of the SEQ ID NOs above and further having a 5' region with sequence 5'-CTAGCATGACTGCAGTACGT (SEQ ID NO. 131) and/or a 3' region with sequence 5'-CTGTCTCTTATACACATCTGACGCTGCCGACGA (SEQ ID NO. 132).

The invention further provides oligonucleotides homologous to the SEQ ID NOs above. For example, the invention provides an oligonucleotide comprising a nucleic acid sequence or a portion thereof that is at least 50, 55, 60, 65, 70, 75, 80, 85, 90, 95, 96, 97, 98, 99 or 100 percent homologous to an oligonucleotide sequence of any one of the SEQ ID NOs above. The homologous sequences may comprise similar properties to the listed sequences, such as similar binding properties.

In an aspect, the invention provides a plurality of oligonucleotides comprising at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 2000, 3000, 4000, 5000, 6000, 7000, 8000, 9000, or at least 10000 different oligonucleotide sequences as described in the paragraphs above. For example, the invention provides a plurality of oligonucleotides comprising member sequences having at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 1500, 2000, 2500, 3000, 3500, 4000, or all variable regions according to SEQ ID NOs 137-969 and 1072-4150.

The plurality of oligonucleotides can comprise at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, or all SEQ ID NOs listed in Table 40. In an embodiment, the plurality of oligonucleotides comprises at least the first 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, or SEQ ID NOs listed in Table 40.

The plurality of oligonucleotides can also comprise at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 225, 250, 275, 300, or all SEQ ID NOs listed in row "2000v1" of Table 43. In an embodiment, the plurality of oligonucleotides comprises at least the first 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 225, 250, 275, 300, or all SEQ ID NOs listed in row "2000v1" of Table 43.

The plurality of oligonucleotides can comprise at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 105, 110, 115, 120, 125, 130, 135, 140, 145 or all SEQ ID NOs listed in row "2000v2" of Table 43. In an embodiment, the plurality of oligonucleotides comprises at least the first 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 105, 110, 115, 120, 125, 130, 135, 140, 145 or all SEQ ID NOs listed in row "2000v2" of Table 43.

The plurality of oligonucleotides can also comprise at least 1, 2, 3, 4, 5, 6, 7, 8, 9, 10, 11, 12, 13, 14, 15, 16, 17 or all variable regions listed in row "Common" of Table 43. In an embodiment, the plurality of oligonucleotides comprises at least the first 1, 2, 3, 4, 5, 6, 7, 8, 9, 10, 11, 12, 13, 14, 15, 16, 17 or all SEQ ID NOs listed in row "Common" of Table 43.

The oligonucleotide or at least one member of the plurality of oligonucleotides can have least one functional modification selected from the group consisting of DNA, RNA, biotinylation, a non-naturally occurring nucleotides, a deletion, an insertion, an addition, and a chemical modification. Such modifications may provide additional or altered functions to the oligonucleotides, including without limitation capture, detection, stability, or binding properties.

Such oligonucleotides and plurality of oligonucleotides (pools) can be used to characterize a phenotype as described herein. In an aspect, the invention provides a method of characterizing a phenotype in a sample comprising: (a) contacting the sample with at least one oligonucleotide or plurality of oligonucleotides provided by the invention (see above); and (b) identifying a presence or level of a complex formed between the at least one oligonucleotide or plurality of oligonucleotides and the sample, wherein the presence or level is used to characterize the phenotype. Any useful technique for identifying can be used according to the invention. In various embodiments, the identifying comprises sequencing, amplification, hybridization, gel electrophoresis or chromatography. In an embodiment, identifying by hybridization comprises contacting the sample with at least one labeled probe that is configured to hybridize with at least one oligonucleotide. The at least one labeled probe can be directly or indirectly attached to a label. Any useful label can be used, including without limitation a fluorescent or magnetic label. In another embodiment, identifying by sequencing comprises next generation sequencing, dye termination sequencing, and/or pyrosequencing.

In the methods of the invention, the complex formed between the at least one oligonucleotide or the plurality of oligonucleotides and the sample can be a complex formed between a microvesicle population in the sample and the at least one oligonucleotide or plurality of oligonucleotides. The microvesicle population can be isolated in whole or in part from other constituents in the sample before of after the contacting. In embodiments, the isolating uses affinity purification, filtration, polymer precipitation, PEG precipitation, ultracentrifugation, a molecular crowding reagent, affinity isolation, affinity selection, or any combination thereof.

In the methods of the invention, the phenotype can be any detectable phenotype. In some embodiments, the phenotype comprises a disease or disorder. In such cases, the characterizing can be a diagnosis, prognosis and/or theranosis for the disease or disorder. The theranosis can be any type of therapy-related such as described herein. The theranosis includes without limitation predicting a treatment efficacy or lack thereof, or monitoring a treatment efficacy.

The characterizing step of the methods of the invention may entail comparing the presence or level to a reference. Any useful reference can be used. In an embodiment wherein the phenotype comprises a disease or disorder, the reference can be the presence or level determined in a sample from an individual without a disease or disorder, or from an individual with a different state of the disease or disorder. In some embodiments, the comparison to the reference of at least one oligonucleotide comprising a sequence having a SEQ ID NO provided above indicates that the sample comprises a cancer sample or a non-cancer/normal sample.

The disease or disorder detected by the oligonucleotide, plurality of oligonucleotides, or methods provided here may comprise any appropriate disease or disorder of interest, including without limitation Breast Cancer, Alzheimer's disease, bronchial asthma, Transitional cell carcinoma of the bladder, Giant cellular osteoblastoclastoma, Brain Tumor, Colorectal adenocarcinoma, Chronic obstructive pulmonary disease (COPD), Squamous cell carcinoma of the cervix, acute myocardial infarction (AMI)/acute heart failure, Chron's Disease, diabetes mellitus type II, Esophageal carcinoma, Squamous cell carcinoma of the larynx, Acute and chronic leukemia of the bone marrow, Lung carcinoma, Malignant lymphoma, Multiple Sclerosis, Ovarian carcinoma, Parkinson disease, Prostate adenocarcinoma, psoriasis, Rheumatoid Arthritis, Renal cell carcinoma, Squamous cell carcinoma of skin, Adenocarcinoma of the stomach, carcinoma of the thyroid gland, Testicular cancer, ulcerative colitis, or Uterine adenocarcinoma.

In some embodiments, the disease or disorder comprises a cancer, a premalignant condition, an inflammatory disease, an immune disease, an autoimmune disease or disorder, a cardiovascular disease or disorder, neurological disease or disorder, infectious disease or pain. The cancer can include without limitation one of acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sézary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenström macroglobulinemia; or Wilm's tumor. The premalignant condition can include without limitation Barrett's Esophagus. The autoimmune disease can include without limitation one of inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. The cardiovascular disease can include without limitation one of atherosclerosis, congestive heart failure, vulnerable plaque, stroke, ischemia, high blood pressure, stenosis, vessel occlusion or a thrombotic event. The neurological disease can include without limitation one of Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain can include without limitation one of fibromyalgia, chronic neuropathic pain, or peripheral neuropathic pain. The infectious disease can include without limitation one of a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, or influenza. One of skill will appreciate that the oligonucleotide or plurality of oligonucleotides or methods of the invention can be used to assess any number of these or other related diseases and disorders.

In some embodiments of the invention, the oligonucleotide or plurality of oligonucleotides and methods of use thereof are useful for characterizing certain diseases or disease states. As desired, a pool of oligonucleotides useful for characterizing various diseases is assembled to create a master pool that can be used to probe useful for characterizing the various diseases. One of skill will also appreciate that pools of oligonucleotides useful for characterizing specific diseases or disorders can be created as well. The sequences provided herein can also be modified as desired so long as the functional aspects are still maintained (e.g., binding to various targets or ability to characterize a phenotype). For example, the oligonucleotides may comprise DNA or RNA, incorporate various non-natural nucleotides, incorporate other chemical modifications, or comprise various deletions or insertions. Such modifications may facilitate synthesis, stability, delivery, labeling, etc, or may have little to no effect in practice. In some cases, some nucleotides in an oligonucleotide may be substituted while maintaining functional aspects of the oligonucleotide. Similarly, 5' and 3' flanking regions may be substituted. In still other cases, only a portion of an oligonucleotide may be determined to direct its functionality such that other portions can be deleted or substituted. Numerous techniques to synthesize and modify nucleotides and polynucleotides are disclosed herein or are known in the art.

In an aspect, the invention provides a kit comprising a reagent for carrying out the methods of the invention provided herein. In a similar aspect, the invention contemplates use of a reagent for carrying out the methods of the invention provided herein. In embodiments, the reagent comprises an oligonucleotide or plurality of oligonucleotides. The oligonucleotide or plurality of oligonucleotides can be those provided herein. The reagent may comprise various other useful components including without limitation microRNA (miR) and messenger RNA (mRNA)), a protein-nucleic acid complex, and various combinations, fragments and/or complexes of any of these. Theone or more of: a) a reagent configured to isolate a microvesicle, optionally wherein the at least one reagent configured to isolate a microvesicle comprises a binding agent to a microvesicle antigen, a column, a substrate, a filtration unit, a polymer, polyethylene glycol, PEG4000, PEG8000, a particle or a bead; b) at least one oligonucleotide configured to act as a primer or probe in order to amplify, sequence, hybridize or detect the oligonucleotide or plurality of oligonucleotides; and c) a reagent configured to remove one or more abundant protein from a sample, wherein optionally the one or more abundant protein comprises at least one of albumin, immunoglobulin, fibrinogen and fibrin.

Recovery of Oligonucleotide Probes Post-Probing

As described herein, the oligonucleotide probes of the invention can be used to probe a sample in order to characterize a phenotype. The methods may entail recovering the oligonucleotide probes that bound various biological entities in the sample in order to identify the bound probes. In an aspect, the invention provides a method of detecting at least one oligonucleotide in a sample, comprising: (a) providing the at least one oligonucleotide comprising a capture moiety; (b) contacting the sample with the at least one oligonucleotide provided in (a); (c) capturing the at least one oligonucleotide that formed a complex with a component in the sample in (b); and (d) identifying a presence or level of the at least one oligonucleotide captured in (c), wherein optionally the presence or level is used to characterize a phenotype. See, e.g., Example 33 and FIGS. 17A-E. The at least one oligonucleotide may be captured to a substrate, including without limitation a bead or planar substrate. The capture moiety can be any useful capture moiety, including without limitation a biotin moiety. The capture moiety can be cleavable, e.g., photocleavable or chemically cleavable. In an embodiment, the at least one oligonucleotide is captured to a substrate coupled to avidin or streptavidin. Such configuration is particularly useful when the capture moiety comprises a biotin moiety. In some embodiments, the captured at least one oligonucleotide is released from the substrate by irradiation prior to the identifying. Any useful irradiation, e.g., ultra violet (UV) light may be used. Any useful technique for identifying can be used according to the invention. In various embodiments, the identifying comprises sequencing, amplification, hybridization, gel electrophoresis or chromatography. In an embodiment, identifying by hybridization comprises contacting the sample with at least one labeled probe that is configured to hybridize with at least one oligonucleotide. The at least one labeled probe can be directly or indirectly attached to a label. Any useful label can be used, including without limitation a fluorescent or magnetic label. In another embodiment, identifying by sequencing comprises next generation sequencing, dye termination sequencing, and/or pyrosequencing. The at least one oligonucleotide can be an oligonucleotide or plurality of oligonucleotides provided by the invention. See e.g., the oligonucleotides and plurality of oligonucleotides described above.

Single Strand DNA (ssDNA) Library Preparation

In an embodiment, the invention provides a nucleic acid molecule comprising a 5' leader region which is 5' of a variable region, which is 5' of a tail region, wherein the leader region comprises a lengthener region, a terminator region and a forward primer region, and the tail region comprises a reverse primer region. The nucleic acid molecule may be used for asymmetric or unequal length PCR applications as desired, e.g., to recover ssDNA. See, e.g., Example 34 and FIGS. 18A-C. The lengthener region can be any desired length. In some embodiments, the lengthener region comprises at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 30, 41, 42, 43, 44, 45, 46, 47, 48, 49, or 50 nucleotides. The lengthener region may comprise a poly-A sequence. Similarly, the terminator region can be any desired length. In some embodiments, the terminator region comprises at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 30, 41, 42, 43, 44, 45, 46, 47, 48, 49, or 50 nucleotides. The terminator region may comprise a non-nucleotide terminator. For example, the non-nucleotide terminator can be a polymer such as triethylene glycol or the like. The forward primer region can be any desired length. In some embodiments, the forward primer region comprises at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 30, 41, 42, 43, 44, 45, 46, 47, 48, 49, or 50 nucleotides. The variable region can be any desired length. In some embodiments, the variable region comprises at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 30, 41, 42, 43, 44, 45, 46, 47, 48, 49, or 50 nucleotides. In some embodiments, the variable region binds a target molecule or complex through non-Watson-Crick base pairing. For example, the variable region may act as an aptamer and bind proteins or other entities. Finally, the reverse primer region can be any desired length. In some embodiments, the reverse primer region comprises at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 30, 41, 42, 43, 44, 45, 46, 47, 48, 49, or 50 nucleotides.

In a related aspect, the invention provides a method of generating a single-stranded DNA (ssDNA) molecule comprising: a) providing a mixture comprising a nucleic acid molecule as described in the paragraph above, and forward and reverse primers configured to amplify the nucleic acid molecule from the forward primer region and reverse primer region, respectively; and b) performing asymmetric polymerase chain reaction (PCR) on the mixture in a) to favorably amplify the reverse strand of the nucleic acid molecule, wherein the forward and reverse primers in the mixture are at a ratio of at least about 1:5 (F/R) in favor of the reverse primers; thereby generating the ssDNA molecule. In an embodiment, the ratio is between about 1:20-1:50 (F/R) in favor of the reverse primers. For example, the ratio can be between about 1:37.5 (F/R) in favor of the reverse primers. The method may further comprise isolating the amplified reverse strand of the nucleic acid molecule on a native gel. The method may also further comprise: c) denaturing the amplified nucleic acid molecules from b); and d) isolating the denatured reverse strand of the nucleic acid molecules from c). In an embodiment, the denatured reverse strand of the nucleic acid molecules is isolated on a denaturing gel. The mixture in a) can comprise additional components as desired. For example, the mixture may further comprise at least one of an enrichment buffer, non-target molecules, proteins, microvesicles, and polyethylene glycol.

In a related aspect, the invention provides a kit comprising a reagent for carrying out the methods herein. In still another related aspect, the invention provides for use of a reagent for carrying out the methods. In various embodiments, the reagent comprises at least one of a buffer, a nucleic acid molecule described above, and forward and/or reverse primers configured to amplify the nucleic acid molecule.

Detecting Watson-Crick Base Pairing with an Oligonucleotide Probe

The oligonucleotide probes provided by the invention can bind via non-Watson Crick base pairing. However, in some cases, the oligonucleotide probes provided by the invention can bind via Watson Crick base pairing. The oligonucleotide probe libraries of the invention, e.g., as described above, can query both types of binding events simultaneously. For example, some oligonucleotide probes may bind the microvesicle protein antigens in the classical aptamer sense, whereas other oligonucleotide probes may bind microvesicles via nucleic acids associated with the microvesicles, e.g., nucleic acid (including without limitation microRNA and mRNA) on the surface of the microvesicles or as payload. Such surface bound nucleic acids can be associated with proteins. For example, they may comprise Argonaute-microRNA complexes. The argonaute protein can be Ago1, Ago2, Ago3 and/or Ago4.

In addition to the oligonucleotide probe library approach described herein which relies on determining a sequence of the oligonucleotides (e.g., via sequencing, hybridization or amplification), assays can also be designed to detect Watson Crick base pairing. In some embodiments, these approaches rely on Ago2-mediated cleavage wherein an Ago2-microRNA complex can be used to detected using oligonucleotide probes. These approaches can use oligonucleotide probes to detect Ago2-microRNA complexes, which may or may not be associated with microvesicles. The detection can be used to characterize a phenotype as described herein. Such detection can be used along side the sequencing identification methods described herein (e.g., via sequencing, hybridization or amplification). For further details, see PCT/US15/62184, filed Nov. 23, 2015, which application is incorporated by reference herein in its entirety.

Therapeutics

As used herein "therapeutically effective amount" refers to an amount of a composition that relieves (to some extent, as judged by a skilled medical practitioner) one or more symptoms of the disease or condition in a mammal. Additionally, by "therapeutically effective amount" of a composition is meant an amount that returns to normal, either partially or completely, physiological or biochemical parameters associated with or causative of a disease or condition. A clinician skilled in the art can determine the therapeutically effective amount of a composition in order to treat or prevent a particular disease condition, or disorder when it is administered, such as intravenously, subcutaneously, intraperitoneally, orally, or through inhalation. The precise amount of the composition required to be therapeutically effective will depend upon numerous factors, e.g., such as the specific activity of the active agent, the delivery device employed, physical characteristics of the agent, purpose for the administration, in addition to many patient specific considerations. But a determination of a therapeutically effective amount is within the skill of an ordinarily skilled clinician upon the appreciation of the disclosure set forth herein.

The terms "treating," "treatment," "therapy," and "therapeutic treatment" as used herein refer to curative therapy, prophylactic therapy, or preventative therapy. An example of "preventative therapy" is the prevention or lessening the chance of a targeted disease (e.g., cancer or other proliferative disease) or related condition thereto. Those in need of treatment include those already with the disease or condition as well as those prone to have the disease or condition to be prevented. The terms "treating," "treatment," "therapy," and "therapeutic treatment" as used herein also describe the management and care of a mammal for the purpose of combating a disease, or related condition, and includes the administration of a composition to alleviate the symptoms, side effects, or other complications of the disease, condition. Therapeutic treatment for cancer includes, but is not limited to, surgery, chemotherapy, radiation therapy, gene therapy, and immunotherapy.

As used herein, the term "agent" or "drug" or "therapeutic agent" refers to a chemical compound, a mixture of chemical compounds, a biological macromolecule, or an extract made from biological materials such as bacteria, plants, fungi, or animal (particularly mammalian) cells or tissues that are suspected of having therapeutic properties. The agent or drug can be purified, substantially purified or partially purified. An "agent" according to the present invention, also includes a radiation therapy agent or a "chemotherapeutic agent."

As used herein, the term "diagnostic agent" refers to any chemical used in the imaging of diseased tissue, such as, e.g., a tumor.

As used herein, the term "chemotherapeutic agent" refers to an agent with activity against cancer, neoplastic, and/or proliferative diseases, or that has ability to kill cancerous cells directly.

As used herein, "pharmaceutical formulations" include formulations for human and veterinary use with no significant adverse toxicological effect. "Pharmaceutically acceptable formulation" as used herein refers to a composition or formulation that allows for the effective distribution of the nucleic acid molecules of the instant invention in the physical location most suitable for their desired activity.

As used herein the term "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated.

Aptamer-Toxin Conjugates as a Cancer Therapeutic

Previous work has developed the concept of antibody-toxin conjugates ("immunoconjugates") as potential therapies for a range of indications, mostly directed at the treatment of cancer with a primary focus on hematological tumors. A variety of different payloads for targeted delivery have been tested in pre-clinical and clinical studies, including protein toxins, high potency small molecule cytotoxics, radioisotopes, and liposome-encapsulated drugs. While these efforts have successfully yielded three FDA-approved therapies for hematological tumors, immunoconjugates as a class (especially for solid tumors) have historically yielded disappointing results that have been attributable to multiple different properties of antibodies, including tendencies to develop neutralizing antibody responses to non-humanized antibodies, limited penetration in solid tumors, loss of target binding affinity as a result of toxin conjugation, and imbalances between antibody half-life and toxin conjugate half-life that limit the overall therapeutic index (reviewed by Reff and Heard, Critical Reviews in Oncology/Hematology, 40 (2001):25-35).

Aptamers are functionally similar to antibodies, except their absorption, distribution, metabolism, and excretion ("ADME") properties are intrinsically different and they generally lack many of the immune effector functions generally associated with antibodies (e.g., antibody-dependent cellular cytotoxicity, complement-dependent cytotoxicity). In comparing many of the properties of aptamers and antibodies previously described, several factors suggest that toxin-delivery via aptamers offers several concrete advantages over delivery with antibodies, ultimately affording them better potential as therapeutics. Several examples of the advantages of toxin-delivery via aptamers over antibodies are as follows:

1) Aptamer-toxin conjugates are entirely chemically synthesized. Chemical synthesis provides more control over the nature of the conjugate. For example, the stoichiometry (ratio of toxins per aptamer) and site of attachment can be precisely defined. Different linker chemistries can be readily tested. The reversibility of aptamer folding means that loss of activity during conjugation is unlikely and provides more flexibility in adjusting conjugation conditions to maximize yields.

2) Smaller size allows better tumor penetration. Poor penetration of antibodies into solid tumors is often cited as a factor limiting the efficacy of conjugate approaches. See Colcher, D., Goel, A., Pavlinkova, G., Beresford, G., Booth, B., Batra, S. K. (1999) "Effects of genetic engineering on the pharmacokinetics of antibodies," Q. J. Nucl. Med., 43: 132-139. Studies comparing the properties of unPEGylated anti-tenascin C aptamers with corresponding antibodies demonstrate efficient uptake into tumors (as defined by the tumor:blood ratio) and evidence that aptamer localized to the tumor is unexpectedly long-lived ($t_{1/2}$>12 hours) (Hicke, B. J., Stephens, A. W., "Escort aptamers: a delivery service for diagnosis and therapy", J. Clin. Invest., 106:923-928 (2000)).

3) Tunable PK. Aptamer half-life/metabolism can be easily tuned to match properties of payload, optimizing the ability to deliver toxin to the tumor while minimizing systemic exposure. Appropriate modifications to the aptamer backbone and addition of high molecular weight PEGs should make it possible to match the half-life of the aptamer to the intrinsic half-life of the conjugated toxin/linker, minimizing systemic exposure to non-functional toxin-bearing metabolites (expected if $t_{1/2}$(aptamer)<<$t_{1/2}$(toxin)) and reducing the likelihood that persisting unconjugated aptamer will functionally block uptake of conjugated aptamer (expected if $t_{1/2}$(aptamer)>>$t_{1/2}$(toxin)).

4) Relatively low material requirements. It is likely that dosing levels will be limited by toxicity intrinsic to the cytotoxic payload. As such, a single course of treatment will likely entail relatively small (<100 mg) quantities of aptamer, reducing the likelihood that the cost of oligonucleotide synthesis will be a barrier for aptamer-based therapies.

5) Parenteral administration is preferred for this indication. There will be no special need to develop alternative formulations to drive patient/physician acceptance.

The invention provides a pharmaceutical composition comprising a therapeutically effective amount of an aptamer provided by the invention or a salt thereof, and a pharmaceutically acceptable carrier or diluent. The invention also provides a pharmaceutical composition comprising a therapeutically effective amount of the aptamer or a salt thereof, and a pharmaceutically acceptable carrier or diluent. Relatedly, the invention provides a method of treating or ameliorating a disease or disorder, comprising administering the pharmaceutical composition to a subject in need thereof. Administering a therapeutically effective amount of the composition to the subject may result in: (a) an enhancement of the delivery of the active agent to a disease site relative to delivery of the active agent alone; or (b) an enhancement of microvesicles clearance resulting in a decrease of at least 10%, 20%, 30%, 40%, 50%, 60%, 70%, 80%, or 90% in a blood level of microvesicles targeted by the aptamer; or (c) an decrease in biological activity of microvesicles targeted by the aptamer of at least 10%, 20%, 30%, 40%, 50%, 60%, 70%, 80%, or 90%. In an embodiment, the biological activity of microvesicles comprises immune suppression or transfer of genetic information. The disease or disorder can include without limitation those disclosed herein. For example, the disease or disorder may comprise a neoplastic, proliferative, or inflammatory, metabolic, cardiovascular, or neurological disease or disorder. See, e.g., section "Phenotypes."

Anti-Target and Multivalent Oligonucleotides

As noted above, the target of oligonucleotide probes can be identified. For example, when the target comprises a protein or protein complex (e.g., a nucleoprotein or lipoprotein), identifying the target may comprise use of mass spectrometry (MS), peptide mass fingerprinting (PMF; protein fingerprinting), sequencing, N-terminal amino acid analysis, C-terminal amino acid analysis, Edman degradation, chromatography, electrophoresis, two-dimensional gel electrophoresis (2D gel), antibody array, or immunoassay. Such approaches can be applied to identify a number of targets recognized by an oligonucleotide probe library. For example, an oligonucleotide probe library can be incubated with a sample of interest, bound members of the library captured, and the targets bound to the captured members identified. See Example 23 herein for an example of such target identification using mass spectrometry.

The oligonucleotide aptamers to the various targets can be used for multiple purposes. In some embodiments, the aptamers are used as therapeutic agents. Immunotherapeutic approaches using antibodies that recognize foreign/misfolded antigens (e.g., anti-CD20, anti-CD30, anti-CD33, anti-CD52, anti-EGFR, anti-nucleolin, anti-nucleophosmin, etc.) can selectively kill target cells via linked therapeutic agents or by stimulating the immune system through activation of cell-mediated cytotoxicity. Aptamers or oligonucleotides are an attractive immunotherapeutic alternative for various reasons such as low cost, small size, ease and speed of synthesis, stability and low immunogenicity. In an embodiment, immunotherapeutic agents are conjugated to disease specific target oligonucleotide or antibody (Ab) for targeted cell killing via recruitment of complement proteins and the downstream membrane attack complex. See, e.g., Zhou and Rossi, Cell-type-specific, Aptamer-functionalized Agents for Targeted Disease Therapy, Mol Ther Nucleic Acids. 2014 Jun. 17; 3:e169. doi: 10.1038/mtna.2014.21; Pei et al., Clinical applications of nucleic acid aptamers in cancer, Mol Clin Oncol. 2014 May; 2(3):341-348. Epub 2014 Feb. 10. This approach can be applied to target diseased host cells such as cancer cells, gram negative bacteria, viral and/or parasitic infections, and the like.

Figure 23C:
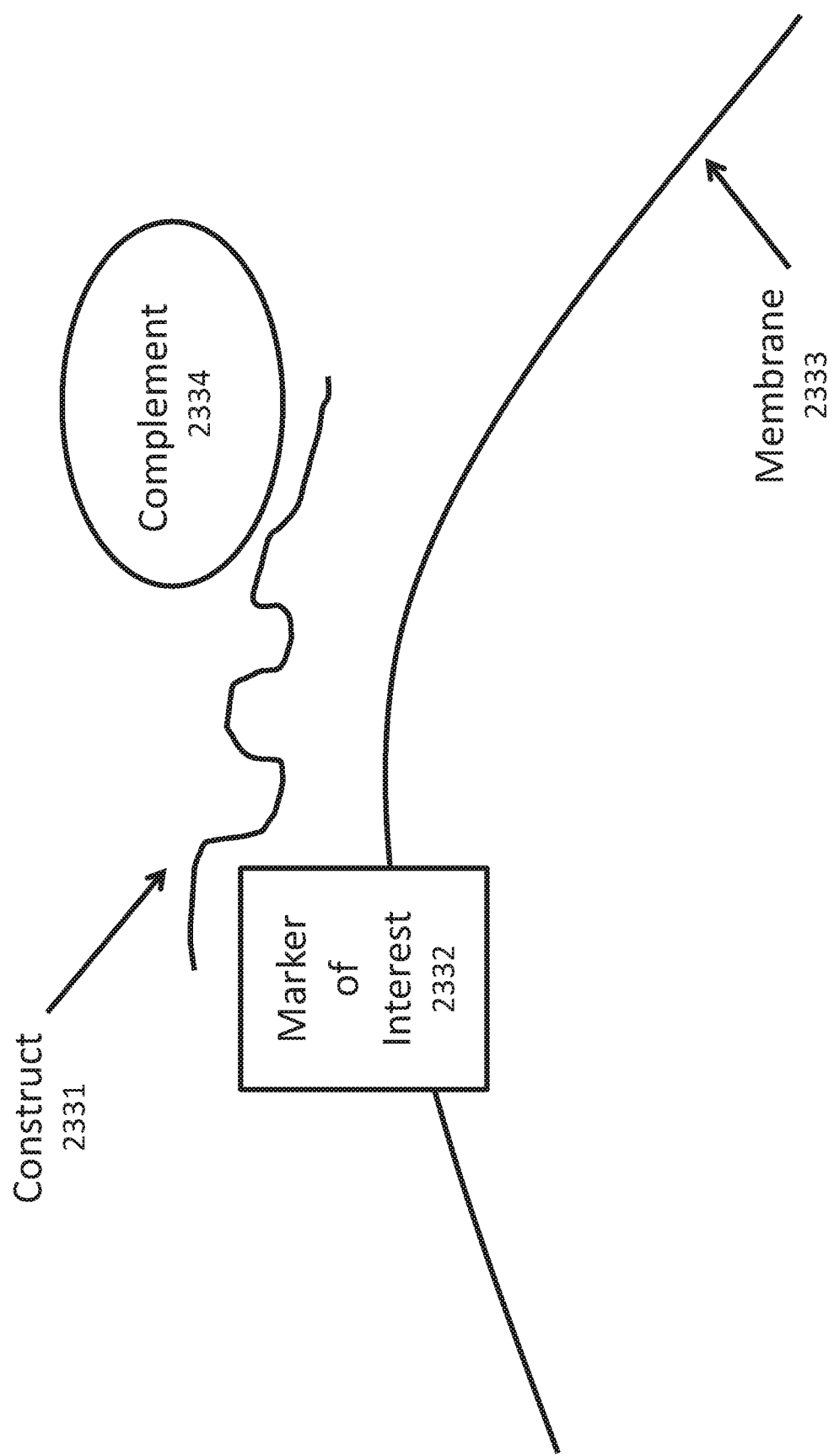

In some embodiments, the invention provides a multipartite construct comprising a binding agent specific to a biological target with another binding agent specific to immunomodulatory entity. Examples of such constructs are shown in FIG. 23A. In Design 1 in the figure, the horizontal line indicates an oligonucleotide construct, which construct comprises a 5' primer 2301 (Primer 1), a variable region 2302 that can be an aptamer to a target of interest, a 3' primer 2303 (Primer 2), and an immunomodulatory domain region ("IMD") 2304. The complete Design 1 construct can be used to bring a target of interest in proximity with an immunomodulatory agent. The primers can be designed for any desired purpose, e.g., amplification, capture, modification, direct or indirect labeling, and the like. In some embodiments, the target of the variable region is a disease marker and thus the construct is targeted to a disease cell or microvesicle. The immunomodulatory domain region can act as an immune stimulator or suppressor. Any appropriate immune stimulator or suppressor can be used, e.g., a small molecule, antibody or an aptamer. Thus, the construct can modulate the immune response at a target of interest, e.g., at a cell or microvesicle carrying the target. The basic construct can be modified as desired. For example, Design 2 in FIG. 23A shows the construct carrying a linker 2305 between Primer 2 2303 and the IMD 2304. Such linkers are explained further below and can be inserted between any components of the construct as desired. Linkers can provide a desired space between the regions of the construct and can be manipulated to influence other properties such as stability. Design 3 in FIG. 23A shows another example wherein the IMD 2304 is an oligonucleotide and the variable region 2302 and IMD 2304 lie between the primers 2301 and 2303. One of skill will appreciate that one or more linker, such as 2305 of Design 2, can also be inserted into Design 3, e.g., between the variable region 2302 and IMD 2304. One of skill will further appreciate that the ordering of the oligonucleotide segments from 5' to 3' can be modified, e.g., reversed. As a concrete example which will be described further below, FIG. 23B illustrates Design 1 and Design 2 from FIG. 23A wherein the variable region comprises an anti-CD20 oligonucleotide 2311 and the IMD comprises an anti-C1q oligonucleotide 2312, e.g., an oligonucleotide provided herein. See, e.g., Example 35. This constructs of FIG. 23B can be used used to target a CD20+ cell population and stimulate C1q mediated cell killing.

As noted, the multipartite constructs may be synthesized and/or modified as desired. In some embodiments of the invention, the multipartite oligonucleotide construct is synthesized directly with or without a linker in between the oligonucleotide segments. See, e.g., FIG. 23A Design 3, which can be generated directly via amplification by Primer 1 2301 and Primer 2 2303. One or more linker can act as a spacer to create a desired spacing between the target of the variable region segment 2302 and the target of the IMD segment 2304. The spacing can be determined via computer modeling or via experimentation due to steric hindrance or other considerations. Following the example of FIG. 23B, the type and size of the linker may be dependent upon steric hindrance between the CD20 target protein and the C1q protein/MAC complex.

The multipartite constructs can be generated against any appropriate target. The targets can include without limitation diseased cells, cancer cells, circulating tumor cells (CTCs), immune cells (e.g., B-cells, T-cells, macrophages, dendritic cells), microvesicles, bacteria, viruses or other parasites. The target can be large biological complexes, e.g., protein complexes, ribonucleoprotein complexes, lipid complexes, or a combination thereof. It will be understood that the specific target of the multipartite constructs can be a certain member of the foregoing macromolecular targets. For example, consider that the desired target of the multipartite construct is a cell or microvesicle. In such case, the multipartite construct can be directed to a specific biomarker, e.g., a surface antigen, of the cell or microvesicle. As a non-limiting example, the target of interest can be B-cells and the specific target of the variable region of the multipartite construct can be CD20. CD20 is a cellular marker of B-cells targeted by the monoclonal antibodies (mAb) rituximab, obinutuzumab, ofatumumab, ibritumomab tiuxetan, and tositumomab, which are used as agents in the treatment of B-cell lymphomas and leukemias. As another non-limiting example, the target of interest can be cancer cells and the specific target of the variable region of the multipartite construct can be c-MET. MET is a membrane receptor that is essential for embryonic development and wound healing. Abnormal MET activation in cancer correlates with poor prognosis, where aberrantly active MET triggers tumor growth, formation of new blood vessels (angiogenesis), and cancer spread to other organs (metastasis). MET has been observed to be deregulated in many types of human malignancies, including cancers of kidney, liver, stomach, breast, and brain. See FIG. 23D for illustration (discussed further below). Other biomarkers can be used as the specific target as desired. For example, the biomarker can be selected from Table 3, Table 4, Tables 18-26, or Table 45 herein. See FIG. 23C, which illustrates a construct of the invention 2331 having a segment that recognizes a biomarker 2332 ("Marker of Interest") on a cell or vesicle surface 2333 ("Membrane"), and another segment 2334 that attracts an immune response ("Complement"). The construct 2331 can be such as in FIGS. 23A-B or any other desired configuration. Binding of such a construct to a target can cause a complement cascade and induce apoptosis.

In some embodiments of the invention, the target biomarker is selected from the group consisting of CD19, CD20, CD21, CD22 (also known as LL2), CDIM, and Lym-1. The target biomarker can be a membrane associated protein. In embodiments, the membrane associated protein is selected from the group consisting of CD4, CD19, DC-SIGN/CD209, HIV envelope glycoprotein gp120, CCR5, EGFR/ErbB, EGFR2/ErbB2/HER2, EGFR3/ErbB3, EGFR4/ErbB4, EGFRvIII, Transferrin Receptor, PSMA, VEGF, VEGF-2, CD25, CD11a, CD33, CD20, CD3, CD52, CEA, TAG-72, LDL receptor, insulin receptor, megalin receptor, LRP, mannose receptor, P63/CKAP4 receptor, arrestin, ASGP, CCK-B, HGFR, RON receptor, FGFR, ILR, AFP, CA125/MUC16, PDGFR, stem cell factor receptor, colony stimulating factor-1 receptor, integrins, TLR, BCR and BAFF-R. The target biomarker can also be a cellular receptor selected from the group consisting of: nucleolin, human epidermal growth factor receptor 2 (HER2), CD20, a transferrin receptor, an asialoglycoprotein receptor, a thyroid-stimulating hormone (TSH) receptor, a fibroblast growth factor (FGF) receptor, CD3, the interleukin 2 (IL-2) receptor, a growth hormone receptor, an insulin receptor, an acetylcholine receptor, an adrenergic receptor, a vascular endothelial growth factor (VEGF) receptor, a protein channel, cadherin, a desmosome, and a viral receptor. In various embodiments, the target biomarker is a cell surface molecule selected from the group consisting of IgM, IgD, IgG, IgA, IgE, CD19, CD20, CD21, CD22, CD24, CD40, CD72, CD79a, CD79b, CD1d, CD5, CD9, CD10, CD1d, CD23, CD27, CD38, CD48, CD80, CD86, CD138, CD148, and combinations thereof. The target biomarker can be a lymphocyte-directing target such as one or more T-cell receptor motifs, T-cell α chains, T-cell β chains, T-cell γ chains, T-cell Δ chains, CCR7, CD3, CD4, CD5, CD7, CD8, CD11b, CD11c, CD16, CD19, CD20, CD21, CD22, CD25, CD28, CD34, CD35, CD40, CD45RA, CD45RO, CD52, CD56, CD62L, CD68, CD80, CD95, CD117, CD127, CD133, CD137 (4-1 BB), CD163, F4/80, IL-4Ra, Sca-1, CTLA-4, GITR, GARP, LAP, granzyme B, LFA-1, or transferrin receptor.

In some embodiments, the target biomarker comprises a growth factor, vascular endothelial growth factor (VEGF), TGF, TGFβ, PDGF, IGF, FGF, cytokine, lymphokine, hematopoietic factor, M-CSR, GM-CSF, TNF, interleukin, IL-1, IL-2, IL-3, IL-4, IL-5, IL-6, IL-7, IL-8, IL-9, IL-10, IL-11, IL-12, IL-13, IL-14, IL-15, IL-16, IL-17, IL18, IFN, TNF0, TNF1, TNF2, G-CSF, Meg-CSF, GM-CSF, thrombopoietin, stem cell factor, erythropoietin, hepatocyte growth factor/NK1, angiogenic factor, angiopoietin, Ang-1, Ang-2, Ang-4, Ang-Y, human angiopoietin-like polypeptide, angiogenin, morphogenic protein-1, bone morphogenic protein receptor, bone morphogenic protein receptor IA, bone morphogenic protein receptor IB, neurotrophic factor, chemotactic factor, CD proteins, CD3, CD4, CD8, CD19, CD20, erythropoietin, osteoinductive factors, immunotoxin, bone morphogenetic protein (BMP), interferon, interferon-alpha, interferon-beta, interferon-gamma, colony stimulating factor (CSF), M-CSF, GM-CSF, G-CSF, superoxide dismutase, T-cell receptor; surface membrane protein, decay accelerating factor, viral antigen, portion of the AIDS envelope, transport protein, homing receptor, addressin, regulatory protein, integrin, CD11a, CD11b, CD11c, CD18, ICAM, VLA-4, VCAM, tumor associated antigen, HER2, HER3, HER4, nucleophosmin, a heterogeneous nuclear ribonucleoproteins (hnRNPs), fibrillarin; or fragments or variants thereof.

In still other embodiments, the target biomarker is selected from the group consisting of epidermal growth factor receptor, transferrin receptor, platelet-derived growth factor receptor, Erb-B2, CD 19, CD20, CD45, CD52, Ep-CAM, alpha ([alpha])-fetoprotein, carcinoembryonic antigen peptide-1, caspase-8, CDC27, CDK4, carcino-embryonic antigen, calcium-activated chloride channel-2, cyclophilin B, differentiation antigen melanoma, elongation factor 2, Ephrin type-A receptor 2, 3, Fibroblast growth factor-5, fibronectin, glycoprotein 250, G antigen, N-acetyl-glucosaminyltransferase V, glycoprotein 100 kD, helicase antigen, human epidermal receptor-2/neurological, heat shock protein 70-2 mutated, human signet ring tumor-2, human telomerase reverse transcriptase, intestinal carboxyl esterase, interleukin 13 receptor [alpha]2 chain, [beta]-D-galactosidase 2-[alpha]-L-fucosyltransferase, melanoma antigen, melanoma antigen recognized by T cells-1/Melanoma antigen A, melanocortin 1 receptor, macrophage colony-stimulating factor, mucin 1, 2, melanoma ubiquitous mutated 1, 2, 3, New York-esophageous 1, ocular albinism type 1 protein, O-linked N-acetyl glucosamine transferase gene, protein 15, promyelocytic leukemia/retinoic acid receptor [alpha], prostate-specific antigen, prostate-specific membrane antigen, receptor-type protein-tyrosinephosphatase kappa, renal antigen, renal ubiquitous 1, 2, sarcoma antigen, squamous antigen rejecting tumor 1, 2, 3, synovial sarcoma, Survivin-2B, synaptotagmin I/synovial sarcoma, X fusion protein, translocation Ets-family leukemia/acute myeloid leukemia 1, transforming growth factor [beta] receptor 2, triosephosphate isomerase, taxol resistant associated protein 3, testin-related gene, tyrosinase related protein 1, and tyrosinase related protein 2.

The target biomarker can be a cancer-associated or tumor associated antigen. The cancer-associated antigen may include without limitation one or more of human Her2/neu, Her1/EGF receptor (EGFR), HER2 (ERBB2), Her3, Her4, A33 antigen, B7H3, CD5, CD19, CD20, CD22, CD23 (IgE Receptor), C242 antigen, 5T4, IL-6, IL-13, vascular endothelial growth factor VEGF (e.g., VEGF-A), VEGFR-1, VEGFR-2, CD30, CD33, CD37, CD40, CD44, CD51, CD52, CD56, CD74, CD80, CD152, CD200, CD221, CCR4, HLA-DR, CTLA-4, N PC-1C, tenascin, vimentin, insulin-like growth factor 1 receptor (IGF-1R), alpha-fetoprotein, insulin-like growth factor 1 (IGF-1), carbonic anhydrase 9 (CA-IX), carcinoembryonic antigen (CEA), integrin αvβ3, integrin α5β1, folate receptor 1, transmembrane glycoprotein NMB, fibroblast activation protein alpha (FAP), glypican 1, glypican 3, glycoprotein 75, TAG-72, MUC1, MUC16 (also known as CA-125), phosphatidylserine, prostate-specific membrane antigen (PMSA), NR-LU-13 antigen, TRAIL-R1, tumor necrosis factor receptor superfamily member 10b (TNFRSF10B or TRAIL-R2), SLAM family member 7 (SLAM F7), EGP40 pancarcinoma antigen, B-cell activating factor (BAFF), platelet-derived growth factor receptor, glycoprotein EpCAM (17-1A), Programmed Death-1 (PD1), Programmed Death Ligand 1 (PD-L1), protein disulfide isomerase (PDI), Phosphatase of Regenerating Liver 3 (PRL-3), prostatic acid phosphatase, Lewis-Y antigen, GD2 (a disialoganglioside expressed on tumors of neuroectodermal origin), or mesothelin. For example, the target can be one or more of human Her2/neu, Her1/EGFR, TNF-a, B7H3 antigen, CD20, VEGF, CD52, CD33, CTLA-4, tenascin, alpha-4 (α4) integrin, IL-23, amyloid-β, Huntingtin, CD25, nerve growth factor (NGF), TrkA, and α-synuclein. In some embodiments, the target biomarker is a tumor antigen selected from the group consisting of PSMA, BRCA1, BRCA2, alpha-actinin-4, BCR-ABL fusion protein (b3a2), CASP-8, β-catenin, Cdc27, CDK4, dek-can fusion protein, Elongation factor 2, ETV6-AML1 fusion protein, LDLR-fucosyltransferase AS fusion protein, hsp70-2, KIAAO205, MART2, MUM-1f, MUM-2, MUM-3, neo-PAP, Myosin class I, OS-9g, pml-RAR alpha fusion protein, PTPRK, K-ras, N-ras, CEA, gp100/Pmel17, Kallikrein 4, mammaglobin-A, Melan-A/MART-1, PSA, TRP-1/gp75, TRP-2, tyrosinase, CPSF, EphA3, G250/MN/CAIX, HER-2/neu, Intestinal carboxyl esterase, alpha-fetoprotein, M-CSF, MUC1, p53, PRAME, RAGE-1, RU2AS, survivin, Telomerase, WT1, or CA125. In still other embodiments, the target biomarker is a tumor antigen selected from the group consisting of 4-1BB, 5T4, AGS-5, AGS-16, Angiopoietin 2, B7.1, B7.2, B7DC, B7H1, B7H2, B7H3, BT-062, BTLA, CAIX, Carcinoembryonic antigen, CTLA4, Cripto, ED-B, ErbB1, ErbB2, ErbB3, ErbB4, EGFL7, EpCAM, EphA2, EphA3, EphB2, EphB3, FAP, Fibronectin, Folate Receptor, Ganglioside GM3, GD2, glucocorticoid-induced tumor necrosis factor receptor (GITR), gp100, gpA33, GPNMB, ICOS, IGFIR, Integrin av, Integrin αvβ, KIR, LAG-3, Lewis Y, Mesothelin, c-MET, MN Carbonic anhydrase IX, MUC1, MUC16, Nectin-4, NKGD2, NOTCH, OX40, OX40L, PD-1, PDL1, PSCA, PSMA, RANKL, ROR1, ROR2, SLC44A4, Syndecan-1, TACI, TAG-72, Tenascin, TIM3, TRAILR1, TRAILR2, VEGFR-1, VEGFR-2, VEGFR-3, and variants thereof. In still other embodiments, the target biomarker is a tumor-associated antigen selected from the group consisting of Lewis Y, Muc-1, erbB-2,-3 and-4, Ep-CAM, EGF-receptor (e.g., EGFR type I or EGFR type II), EGFR deletion neoepitope, CA19-9, Muc-1, LeY, TF-, Tn- and sTn-antigen, TAG-72, PSMA, STEAP, Cora antigen, CD7, CD19 and CD20, CD22, CD25, Ig-α and Ig-β, A33 and G250, CD30, MCSP and gp100, CD44-v6, MT-MMPs, (MIS) receptor type II, carboanhydrase 9, F19-antigen, Ly6, desmoglein 4, PSCA, Wue-1, GD2 and GD3 as well as TM4SF-antigens (CD63, L6, CO-29, SAS) and the alpha and/or gamma subunit of the fetal type acetylcholinreceptor (AChR). The target biomarker can be a cancer antigen selected from A33, BAGE, Bcl-2, β-catenin, CA125, CA19-9, CD5, CD19, CD20, CD21, CD22, CD33, CD37, CD45, CD123, CEA, c-Met, CS-1, cyclin B1, DAGE, EBNA, EGFR, ephrinB2, estrogen receptor, FAP, ferritin, folate-binding protein, GAGE, G250, GD-2, GM2, gp75, gp100 (Pmel 17), HER-2/neu, HPV E6, HPV E7, Ki-67, LRP, mesothelin, p53, PRAME, progesterone receptor, PSA, PSMA, MAGE, MART, mesothelin, MUC, MUM-1-B, myc, NYESO-1, ras, RORI, survivin, tenascin, TSTA tyrosinase, VEGF, and WT1. The target biomarker can also be a tumor antigen selected from carcinoembryonic antigen (CEA), alpha-fetoprotein (AFP), prostate specific antigen (PSA), prostate specific membrane antigen (PSMA), CA-125 (epithelial ovarian cancer), soluble Interleukin-2 (IL-2) receptor, RAGE-1, tyrosinase, MAGE-1, MAGE-2, NY-ESO-1, Melan-A/MART-1, glycoprotein (gp) 75, gp100, beta-catenin, PRAME, MUM-1, ZFP161, Ubiquilin-1, HOX-B6, YB-1, Osteonectin, ILF3, or IGF-1. In some embodiments, the cancer-related antigen is one or more of CD2, CD4, CD19, CD20, CD22, CD23, CD30, CD33, CD37, CD40, CD44v6, CD52, CD56, CD70, CD74, CD79a, CD80, CD98, CD138, EGFR (Epidermal growth factor receptor), VEGF (Vascular endothelial growth factor), VEG-FRI (Vascular endothelial growth factor receptor I), PDGFR (Platelet-derived growth factor receptor), RANKL (Receptor activator of nuclear factor kappa-B ligand), GPNMB (Transmembrane glycoprotein Neuromedin B), EphA 2 (Ephrin type-A receptor 2), PSMA (Prostate-specific membrane antigen), Cripto (Cryptic family protein 1B), EpCAM (Epithelial cell adhesion molecule), CTLA 4 (Cytotoxic T-Lymphocyte Antigen 4), IGF-IR (Type 1 insulin-like growth factor receptor), GP3 (M13 bacteriophage), GP9 (Glycoprotein IX (platelet), CD42a, GP 40 (Glycoprotein 40 kDa), GPC3 (glypican-3), GPC1 (glypican-1), TRAILR1 (Tumor necrosis factor-related apoptosis-inducing ligand receptor 1), TRAILRII (Tumor necrosis factor-related apoptosis-inducing ligand receptor II), FAS (Type II transmembrane protein), PS (phosphatidyl serine) lipid, Gal GalNac Gal N-linked, Muc1 (Mucin 1, cell surface associated, PEM), Muc18, CD146, A5B1 integrin (α5β1), α4β1 integrin, αv integrin (Vitronectin Receptor), Chondrolectin, CAIX (Carbonic anhydrase IX, gene G250/MN-encoded transmembrane protein), GD2 ganglioside, GD3 ganglioside, GM1 ganglioside, Lewis Y, Mesothelin, HER2 (Human Epidermal Growth factor 2), HER3, HER4, FN14 (Fibroblast Growth Factor Inducible 14), CS1 (Cell surface glycoprotein, CD2 subset 1, CRACC, SLAMF7, CD319), 41BB CD137, SIP (Siah-1 Interacting Protein), CTGF (Connective tissue growth factor), HLADR (MHC class II cell surface receptor), PD-1 (Programmed Death 1, Type I membrane protein, PD-L1 (Programmed Death Ligand 1), PD-L2 (Programmed Death Ligand 2), IL-2 (Interleukin-2), IL-8 (Interleukin-8), IL-13 (Interleukin-13), PIGF (Phosphatidylinositol-glycan biosynthesis class F protein), NRP1 (Neuropilin-1), ICAM1, CD54, GC182 (Claudin 18.2), Claudin, HGF (Hepatocyte growth factor), CEA (Carcinoembryonic antigen), LTβR (lymphotoxin β receptor), Kappa Myeloma, Folate Receptor alpha, GRP78 (BIP, 78 kDa Glucose-regulated protein), A33 antigen, PSA (Prostate-specific antigen), CA 125 (Cancer antigen 125 or carbohydrate antigen 125), CA19.9, CA15.3, CA242, leptin, prolactin, osteopontin, IGF-II (Insulin-like growth factor 2), fascin, sPIgR (secreted chain of polymorphic immunoglobulin receptor), 14-3-3 protein eta, 5T4 oncofetal protein, ETA (epithelial tumor antigen), MAGE (Melanoma-associated antigen), MAPG (Melanoma-associated proteoglycan, NG2), vimentin, EPCA-1 (Early prostate cancer antigen-2), TAG-72 (Tumor-associated glycoprotein 72), factor VIII, Neprilysin (Membrane metallo-endopeptidase) and 17-1 A (Epithelial cell surface antigen 17-1A). The cancer antigen can be selected from the group consisting of carbonic anhydrase IX, alpha-fetoprotein, A3, antigen specific for A33 antibody, Ba 733, BrE3-antigen, CA125, CD1, CD1a, CD3, CD5, CD15, CD16, CD19, CD20, CD21, CD22, CD23, CD25, CD30, CD33, CD38, CD45, CD74, CD79a, CD80, CD138, colon-specific antigen-p (CSAp), CEA (CEACAM5), CEACAM6, CSAp, EGFR, EGP-1, EGP-2, Ep-CAM, Flt-1, Flt-3, folate receptor, HLA-DR, human chorionic gonadotropin (HCG) and its subunits, HER2/neu, hypoxia inducible factor (HIF-1), Ia, IL-2, IL-6, IL-8, insulin growth factor-1 (IGF-1), KC4-antigen, KS-1-antigen, KS1-4, Le-Y, macrophage inhibition factor (MIF), MAGE, MUC1, MUC2, MUC3, MUC4, MUC16, NCA66, NCA95, NCA90, antigen specific for PAM-4 antibody, placental growth factor, p53, prostatic acid phosphatase, PSA, PSMA, RS5, S100, TAC, TAG-72, tenascin, TRAIL receptors, Tn antigen, Thomson-Friedenreich antigens, tumor necrosis antigens, VEGF, ED-B fibronectin, 17-1A-antigen, an angiogenesis marker, an oncogene marker and an oncogene product.

The tumor marker can be a generic tumor marker or be associated with certain tumor types, such as those originating from different anatomical origins. In an embodiment, the tumor marker can be chosen to correspond to a certain tumor type. For example, exemplary tumor markers and associated tumor types include without limitation the following, listed as antigen (optional name) (cancer types): Alpha fetoprotein (AFP) (germ cell tumor, hepatocellular carcinoma); CA15-3 (breast cancer); CA27-29 (breast cancer); CA19-9 (mainly pancreatic cancer, but also colorectal cancer and other types of gastrointestinal cancer); CA-125 (ovarian cancer, endometrial cancer, fallopian tube cancer, lung cancer, breast cancer and gastrointestinal cancer); Calcitonin (medullary thyroid carcinoma); Calretinin (mesothelioma, sex cord-gonadal stromal tumour, adrenocortical carcinoma, synovial sarcoma); Carcinoembryonic antigen (gastrointestinal cancer, cervix cancer, lung cancer, ovarian cancer, breast cancer, urinary tract cancer); CD34 (hemangiopericytoma/solitary fibrous tumor, pleomorphic lipoma, gastrointestinal stromal tumor, dermatofibrosarcoma protuberans); CD99 (MIC2) (Ewing sarcoma, primitive neuroectodermal tumor, hemangiopericytoma/solitary fibrous tumor, synovial sarcoma, lymphoma, leukemia, sex cord-gonadal stromal tumour); CD117 (gastrointestinal stromal tumor, mastocytosis, seminoma); Chromogranin (neuroendocrine tumor); Chromosomes 3, 7, 17, and 9p21 (bladder cancer); Cytokeratin (various types) (various carcinoma, some types of sarcoma); Desmin (smooth muscle sarcoma, skeletal muscle sarcoma, endometrial stromal sarcoma); Epithelial membrane antigen (EMA) (many types of carcinoma, meningioma, some types of sarcoma); Factor VIII (CD31, FL1) (vascular sarcoma); Glial fibrillary acidic protein (GFAP) (glioma (astrocytoma, ependymoma)); Gross cystic disease fluid protein (GCDFP-15) (breast cancer, ovarian cancer, salivary gland cancer); HMB-45 (melanoma, PEComa (for example angiomyolipoma), clear cell carcinoma, adrenocortical carcinoma); Human chorionic gonadotropin (hCG) (gestational trophoblastic disease, germ cell tumor, choriocarcinoma); Immunoglobulin (lymphoma, leukemia); Inhibin (sex cord-gonadal stromal tumour, adrenocortical carcinoma, hemangioblastoma); keratin (various types) (carcinoma, some types of sarcoma); lymphocyte marker (various types, lymphoma, leukemia); MART-1 (Melan-A) (melanoma, steroid-producing tumors (adrenocortical carcinoma, gonadal tumor)); Myo D1 (rhabdomyosarcoma, small, round, blue cell tumour); muscle-specific actin (MSA) (myosarcoma (leiomyosarcoma, rhabdomyosarcoma); neurofilament (neuroendocrine tumor, small-cell carcinoma of the lung); neuron-specific enolase (NSE) (neuroendocrine tumor, small-cell carcinoma of the lung, breast cancer); placental alkaline phosphatase (PLAP) (seminoma, dysgerminoma, embryonal carcinoma); prostate-specific antigen (prostate); PTPRC (CD45) (lymphoma, leukemia, histiocytic tumor); S100 protein (melanoma, sarcoma (neurosarcoma, lipoma, chondrosarcoma), astrocytoma, gastrointestinal stromal tumor, salivary gland cancer, some types of adenocarcinoma, histiocytic tumor (dendritic cell, macrophage)); smooth muscle actin (SMA) (gastrointestinal stromal tumor, leiomyosarcoma, PEComa); synaptophysin (neuroendocrine tumor); thyroglobulin (thyroid cancer but not typically medullary thyroid cancer); thyroid transcription factor-1 (all types of thyroid cancer, lung cancer); Tumor M2-PK (colorectal cancer, Breast cancer, renal cell carcinoma, Lung cancer, Pancreatic cancer, Esophageal Cancer, Stomach Cancer, Cervical Cancer, Ovarian Cancer); Vimentin (sarcoma, renal cell carcinoma, endometrial cancer, lung carcinoma, lymphoma, leukemia, melanoma). Additional tumor types and associated biomarkers comprise the following, listed as tumor type (markers): Colorectal (M2-PK, CEA, CA 19-9, CA 125); Breast (CEA, CA 15-3, Cyfra 21-1); Ovary (CEA, CA 19-9, CA 125, AFP, BHCG); Uterine (CEA, CA 19-9, CA 125, Cyfra 21-1, SCC); Prostate (PSA); Testicle (AFP, BHCG); Pancreas/Stomach (CEA, CA 19-9, CA 72-4); Liver (CEA, AFP); Oesophagus (CEA, Cyfra 21-1); Thyroid (CEA, NSE); Lung (CEA, CA 19-9, CA 125, NSE, Cyfra 21-1); Bladder (CEA, Cyfra 21-1, TPA). One or more of these markers can be used as the target biomarker recognized by the variable region of the multipartite construct of the invention.

In some embodiments of the invention, the target biomarker recognized by the variable region comprises one or more of PDGF, IgE, IgE Fcε R1, PSMA, CD22, TNF-alpha, CTLA4, PD-1, PD-L1, PD-L2, FcRIIB, BTLA, TIM-3, CD11c, BAFF, B7-X, CD19, CD20, CD25, and CD33. The target biomarker can also be a protein comprising one or more of insulin-like growth factor 1 receptor (IGF1R), IGF2R, insulin-like growth factor (IGF), mesenchymal epithelial transition factor receptor (c-met), hepatocyte growth factor (HGF), epidermal growth factor receptor (EGFR), ErbB2, ErbB3, epidermal growth factor (EGF), heregulin, fibroblast growth factor receptor (FGFR), platelet-derived growth factor receptor (PDGFR), platelet-derived growth factor (PDGF), vascular endothelial growth factor receptor (VEGFR), vascular endothelial growth factor (VEGF), tumor necrosis factor receptor (TNFR), tumor necrosis factor alpha (TNF-a), folate receptor (FOLR), folate, transferrin receptor (TfR), mesothelia, Fc receptor, c-kit receptor, c-kit, a4 integrin, P-selectin, sphingosine-1-phosphate receptor-1 (S1PR), hyaluronate receptor, leukocyte function antigen-1 (LFA-1), CD4, CD11, CD18, CD20, CD25, CD27, CD52, CD70, CD80, CD85, CD95 (Fas receptor), CD106 (vascular cell adhesion molecule 1 (VCAM1)), CD166 (activated leukocyte cell adhesion molecule (ALCAM)), CD 178 (Fas ligand), CD253 (TNF-related apoptosis-inducing ligand (TRAIL)), inducible costimulator (ICOS) ligand, CCR2, CXCR3, CCR5, CXCL12 (stromal cell-derived factor 1 (SDF-1)), interleukin 1 (IL-1), cytotoxic T-lymphocyte antigen 4 (CTLA-4), MART-1, gp100, MAGE-1, ephrin (Eph) receptor, mucosal addressin cell adhesion molecule 1 (MAdCAM-1), carcinoembryonic antigen (CEA), LewisY, MUC-1, epithelial cell adhesion molecule (EpCAM), cancer antigen 125 (CA125), prostate specific membrane antigen (PSMA), TAG-72 antigen, and fragments thereof. In various embodiments, the target biomarker comprises one or more of PSMA, PSCA, e selectin, an ephrin, ephB2, cripto-1, TENB2 (TEMFF2), ERBB2 receptor (HER2), MUC1, CD44v6, CD6, CD19, CD20, CD22, CD23, CD25, CD30, CD33, CD56, IL-2 receptor, HLA-DR10 B subunit, EGFR, CA9, caveolin-1 and nucleolin.

The target biomarker can be a microvesicle antigen, such as a microvesicle antigen selected from any of Table 3, Table 4, Tables 18-26, or Table 45. For example, the target biomarker can be one or more microvesicle antigen selected from CD9, EphA2, EGFR, B7H3, PSMA, PCSA, CD63, STEAP, CD81, B7H3, STEAP1, ICAM1 (CD54), A33, DR3, CD66e, MFG-e8, Hepsin, TMEM211, TROP-2, EGFR, Mammoglobin, Hepsin, NPGP/NPFF2, PSCA, 5T4, NGAL, NK-2, EpCam, NK-1R, 5T4, PAI-1, and CD45. The target biomarker can be one or more microvesicle antigen selected from SPB, SPC, NSE, PGP9.5, CD9, P2RX7, NDUFB7, NSE, Ga13, Osteopontin, CHI3L1, EGFR, B7H3, iC3b, MUC1, Mesothelin, SPA, TPA, PCSA, CD63, AQPS, DLL4, CD81, DR3, PSMA, GPCR 110 (GPR1 10), EPHA2, CEACAM, PTP, CABYR, TMEM211, ADAM28, UNC93a, A33, CD24, CD10, NGAL, EpCam, MUC17, TROP2 and MUC2. In some embodiments, the target biomarker comprises one or more microvesicle antigen selected from CD9, CD63, CD81, B7H3, PRO GRP, CYTO 18, FTH1, TGM2, CENPH, ANNEXIN I, ANNEXIN V, ERBB2, EGFR, CRP, VEGF, CYTO 19, CCL2, Osteopontin (OST19), Osteopontin (OST22), BTUB, CD45, TIMP, NACC1, MMP9, BRCA1, P27, NSE, M2PK, HCG, MUC1, CEA, CEACAM, CYTO 7, EPCAM, MS4A1, MUC1, MUC2, PGP9, SPA, SPA, SPD, P53, GPCR (GPR110), SFTPC, UNCR2, NSE, INGA3, INTO b4, MMP1, PNT, RACK1, NAP2, HLA, BMP2, PTH1R, PAN ADH, NCAM, CD151, CKS1, FSHR, HIF, KRAS, LAMP2, SNAIL, TRIM29, TSPAN1, TWIST1, ASPH and AURKB. In another embodiment, the target biomarker is selected from the group of proteins consisting of CD9, PSMA, PCSA, CD63, CD81, B7H3, IL 6, OPG-13, IL6R, PA2G4, EZH2, RUNX2, SERPINB3, and EpCam. In another embodiment, a target biomarker is selected from the group of proteins consisting of A33, a33 n15, AFP, ALA, ALIX, ALP, AnnexinV, APC, ASCA, ASPH (246-260), ASPH (666-680), ASPH (A-10), ASPH (D01P), ASPH (D03), ASPH (G-20), ASPH (H-300), AURKA, AURKB, B7H3, B7H4, BCA-225, BCNP1, BDNF, BRCA, CA125 (MUC16), CA-19-9, C-Bir, CD1.1, CD10, CD174 (Lewis y), CD24, CD44, CD46, CD59 (MEM-43), CD63, CD66e CEA, CD73, CD81, CD9, CDA, CDAC1 1a2, CEA, C-Erb2, C-erbB2, CRMP-2, CRP, CXCL12, CYFRA21-1, DLL4, DR3, EGFR, Epcam, EphA2, EphA2 (H-77), ER, ErbB4, EZH2, FASL, FRT, FRT c.f23, GDF15, GPCR, GPR30, Gro-alpha, HAP, HBD 1, HBD2, HER 3 (ErbB3), HSP, HSP70, hVEGFR2, iC3b, IL 6 Unc, IL-1B, IL6 Unc, IL6R, IL8, IL-8, INSIG-2, KLK2, L1CAM, LAMN, LDH, MACC-1, MAPK4, MART-1, MCP-1, M-CSF, MFG-E8, MIC1, MIF, MIS RII, MMG, MMP26, MMP7, MMP9, MS4A1, MUC1, MUC1 seq1, MUC1 seq11A, MUC17, MUC2, Ncam, NGAL, NPGP/NPFF2, OPG, OPN, p53, p53, PA2G4, PBP, PCSA, PDGFRB, PGP9.5, PIM1, PR (B), PRL, PSA, PSMA, PSME3, PTEN, R5-CD9 Tube 1, Reg IV, RUNX2, SCRN1, seprase, SERPINB3, SPARC, SPB, SPDEF, SRVN, STAT 3, STEAP1, TF (FL-295), TFF3, TGM2, TIMP-1, TIMP1, TIMP2, TMEM211, TMPRSS2, TNF-alpha, Trail-R2, Trail-R4, TrKB, TROP2, Tsg 101, TWEAK, UNC93A, VEGF A, and YPSMA-1. The target biomarker can be selected from the group of proteins consisting of 5T4, A33, ACTG1, ADAM10, ADAM15, AFP, ALA, ALDOA, ALIX, ALP, ALX4, ANCA, Annexin V, ANXA2, ANXA6, APC, APOA1, ASCA, ASPH, ATP1A1, AURKA, AURKB, B7H3, B7H4, BANK1, BASP1, BCA-225, BCNP1, BDNF, BRCA, C1orf58, C20orf114, C8B, CA125 (MUC16), CA-19-9, CAPZA1, CAV1, C-Bir, CCSA-2, CCSA-3&4, CD1.1, CD10, CD151, CD174 (Lewis y), CD24, CD2AP, CD37, CD44, CD46, CD53, CD59, CD63, CD66 CEA, CD73, CD81, CD82, CD9, CDA, CDAC1 1a2, CEA, C-Erbb2, CFL1, CFP, CHMP4B, CLTC, COTL1, CRMP-2, CRP, CRTN, CTNND1, CTSB, CTSZ, CXCL12, CYCS, CYFRA21-1, DcR3, DLL4, DPP4, DR3, EEF1A1, EGFR, EHD1, ENO1, EpCAM, EphA2, ER, ErbB4, EZH2, F11R, F2, F5, FAM125A, FASL, Ferritin, FNBP1L, FOLH1, FRT, GAL3, GAPDH, GDF15, GLB1, GPCR (GPR110), GPR30, GPX3, GRO-1, Gro-alpha, HAP, HBD 1, HBD2, HER 3 (ErbB3), HIST1H1C, HIST1H2AB, HNP1-3, HSP, HSP70, HSP90AB1, HSPA1B, HSPA8, hVEGFR2, iC3b, ICAM, IGSF8, IL 6, IL-1B, IL6R, IL8, IMP3, INSIG-2, ITGB1, ITIH3, JUP, KLK2, L1CAM, LAMN, LDH, LDHA, LDHB, LUM, LYZ, MACC-1, MAPK4, MART-1, MCP-1, M-CSF, MFGE8, MGAM, MGC20553, MIC1, MIF, MIS RII, MMG, MMP26, MMP7, MMP9, MS4A1, MUC1, MUC17, MUC2, MYH2, MYL6B, Ncam, NGAL, NME1, NME2, NNMT, NPGP/NPFF2, OPG, OPG-13, OPN, p53, PA2G4, PABPC1, PABPC4, PACSIN2, PBP, PCBP2, PCSA, PDCD6IP, PDGFRB, PGP9.5, PIM1, PR (B), PRDX2, PRL, PSA, PSCA, PSMA, PSMA1, PSMA2, PSMA4, PSMA6, PSMA7, PSMB1, PSMB2, PSMB3, PSMB4, PSMB5, PSMB6, PSMB8, PSME3, PTEN, PTGFRN, Rab-5b, Reg IV, RPS27A, RUNX2, SCRN1, SDCBP, seprase, Sept-9, SERINC5, SERPINB3, SERPINB3, SH3GL1, SLC3A2, SMPDL3B, SNX9, SPARC, SPB, SPDEF, SPON2, SPR, SRVN, SSx2, SSx4, STAT 3, STEAP, STEAP1, TACSTD1, TCN2, tetraspanin, TF (FL-295), TFF3, TGM2, THBS1, TIMP, TIMP1, TIMP2, TMEM211, TMPRSS2, TNF-alpha, TPA, TPI1, TPS, Trail-R2, Trail-R4, TrKB, TROP2, TROP2, Tsg 101, TUBB, TWEAK, UNC93A, VDAC2, VEGF A, VPS37B, YPSMA-1, YWHAG, YWHAQ, and YWHAZ. In another embodiment, the target biomarker is selected from the group of proteins consisting of 5T4, ACTG1, ADAM10, ADAM15, ALDOA, ANXA2, ANXA6, APOA1, ATP1A1, BASP1, C1orf58, C20orf114, C8B, CAPZA1, CAV1, CD151, CD2AP, CD59, CD9, CD9, CFL1, CFP, CHMP4B, CLTC, COTL1, CTNND1, CTSB, CTSZ, CYCS, DPP4, EEF1A1, EHD1, ENO1, F11R, F2, F5, FAM125A, FNBP1L, FOLH1, GAPDH, GLB1, GPX3, HIST1H1C, HIST1H2AB, HSP90AB1, HSPA1B, HSPA8, IGSF8, ITGB1, ITIH3, JUP, LDHA, LDHB, LUM, LYZ, MFGE8, MGAM, MMP9, MYH2, MYL6B, NME1, NME2, PABPC1, PABPC4, PACSIN2, PCBP2, PDCD6IP, PRDX2, PSA, PSMA, PSMA1, PSMA2, PSMA4, PSMA6, PSMA7, PSMB1, PSMB2, PSMB3, PSMB4, PSMB5, PSMB6, PSMB8, PTGFRN, RPS27A, SDCBP, SERINC5, SH3GL1, SLC3A2, SMPDL3B, SNX9, TACSTD1, TCN2, THBS1, TPI1, TSG101, TUBB, VDAC2, VPS37B, YWHAG, YWHAQ, and YWHAZ. In another embodiment, the target biomarker is selected from the group of proteins consisting of CD9, CD63, CD81, PSMA, PCSA, B7H3 and EpCam. In another embodiment, the target biomarker is selected from the group of proteins consisting of a tetraspanin, CD9, CD63, CD81, CD63, CD9, CD81, CD82, CD37, CD53, Rab-5b, Annexin V, MFG-E8, Muc1, GPCR 110, TMEM211 and CD24 In another embodiment, the target biomarker is selected from the group of proteins consisting of A33, AFP, ALIX, ALX4, ANCA, APC, ASCA, AURKA, AURKB, B7H3, BANK1, BCNP1, BDNF, CA-19-9, CCSA-2, CCSA-3&4, CD10, CD24, CD44, CD63, CD66 CEA, CD66e CEA, CD81, CD9, CDA, C-Erb2, CRMP-2, CRP, CRTN, CXCL12, CYFRA21-1, DcR3, DLL4, DR3, EGFR, Epcam, EphA2, FASL, FRT, GAL3, GDF15, GPCR (GPR110), GPR30, GRO-1, HBD 1, HBD2, HNP1-3, IL-1B, IL8, IMP3, L1CAM, LAMN, MACC-1, MGC20553, MCP-1, M-CSF, MIC1, MIF, MMP7, MMP9, MS4A1, MUC1, MUC17, MUC2, Ncam, NGAL, NNMT, OPN, p53, PCSA, PDGFRB, PRL, PSMA, PSME3, Reg IV, SCRN1, Sept-9, SPARC, SPON2, SPR, SRVN, TFF3, TGM2, TIMP-1, TMEM211, TNF-alpha, TPA, TPS, Trail-R2, Trail-R4, TrKB, TROP2, Tsg 101, TWEAK, UNC93A, and VEGFA. In another embodiment, the target biomarker is selected from the group of proteins consisting of CD9, EGFR, NGAL, CD81, STEAP, CD24, A33, CD66E, EPHA2, Ferritin, GPR30, GPR110, MMP9, OPN, p53, TMEM211, TROP2, TGM2, TIMP, EGFR, DR3, UNC93A, MUC17, EpCAM, MUC1, MUC2, TSG101, CD63, B7H3, CD24, and a tetraspanin. The target biomarker can be selected from the group of proteins consisting of 5HT2B, 5T4 (trophoblast), ACO2, ACSL3, ACTN4, ADAM10, AGR2, AGR3, ALCAM, ALDH6A1, ANGPTL4, ANO9, AP1G1, APC, APEX1, APLP2, APP (Amyloid precursor protein), ARCN1, ARHGAP35, ARL3, ASAH1, ASPH (A-10), ATP1B1, ATP1B3, ATP5I, ATP5O, ATXN1, B7H3, BACE1, BAI3, BAIAP2, BCA-200, BDNF, BigH3, BIRC2, BLVRB, BRCA, BST2, C1GALT1, C1GALT1C1, C20orf3, CA125, CACYBP, Calmodulin, CAPN1, CAPNS1, CCDC64B, CCL2 (MCP-1), CCT3, CD10(BD), CD127 (IL7R), CD174, CD24, CD44, CD80, CD86, CDH1, CDH5, CEA, CFL2, CHCHD3, CHMP3, CHRDL2, CIB1, CKAP4, COPA, COX5B, CRABP2, CRIP1, CRISPLD1, CRMP-2, CRTAP, CTLA4, CUL3, CXCR3, CXCR4, CXCR6, CYB5B, CYB5R1, CYCS, CYFRA 21, DBI, DDX23, DDX39B, derlin 1, DHCR7, DHX9, DLD, DLL4, DNAJB1, DPP6, DSTN, eCadherin, EEF1D, EEF2, EFTUD2, EIF4A2, EIF4A3, EpCaM, EphA2, ER(1) (ESR1), ER(2) (ESR2), Erb B4, Erbb2, erbb3 (Erb-B3), ERLIN2, ESD, FARSA, FASN, FEN1, FKBP5, FLNB, FOXP3, FUS, Gal3, GCDPF-15, GCNT2, GNA12, GNG5, GNPTG, GPC1, GPC2, GPC3, GPC4, GPC5, GPC6, GPD2, GPER (GPR30), GSPT1, H3F3B, H3F3C, HADH, HAP1, HER3, HIST1H1C, HIST1H2AB, HIST1H3A, HIST1H3C, HIST1H3D, HIST1H3E, HIST1H3F, HIST1H3G, HIST1H3H, HIST1H3I, HIST1H3J, HIST2H2BF, HIST2H3A, HIST2H3C, HIST2H3D, HIST3H3, HMGB1, HNRNPA2B1, HNRNPAB, HNRNPC, HNRNPD, HNRNPH2, HNRNPK, HNRNPL, HNRNPM, HNRNPU, HPS3, HSP-27, HSP70, HSP90B1, HSPA1A, HSPA2, HSPA9, HSPE1, IC3b, IDE, IDH3B, IDO1, IFI30, IL1RL2, IL7, IL8, ILF2, ILF3, IQCG, ISOC2, IST1, ITGA7, ITGB7, junction plakoglobin, Keratin 15, KRAS, KRT19, KRT2, KRT7, KRT8, KRT9, KTN1, LAMP1, LMNA, LMNB1, LNPEP, LRPPRC, LRRC57, Mammaglobin, MAN1A1, MAN1A2, MART1, MATR3, MBD5, MCT2, MDH2, MFGE8, MFGE8, MGP, MMP9, MRP8, MUC1, MUC17, MUC2, MYO5B, MYOF, NAPA, NCAM, NCL, NG2 (CSPG4), Ngal, NHE-3, NME2, NONO, NPM1, NQO1, NT5E (CD73), ODC1, OPG, OPN (SC), OS9, p53, PAC-SIN3, PAICS, PARK7, PARVA, PC, PCNA, PCSA, PD-1, PD-L1, PD-L2, PGP9.5, PHB, PHB2, PIK3C2B, PKP3, PPL, PR(B), PRDX2, PRKCB, PRKCD, PRKDC, PSA, PSAP, PSMA, PSMB7, PSMD2, PSME3, PYCARD, RAB1A, RAB3D, RAB7A, RAGE, RBL2, RNPEP, RPL14, RPL27, RPL36, RPS25, RPS4X, RPS4Y1, RPS4Y2, RUVBL2, SET, SHMT2, SLAIN1, SLC39A14, SLC9A3R2, SMARCA4, SNRPD2, SNRPD3, SNX33, SNX9, SPEN, SPR, SQSTM1, SSBP1, ST3GAL1, STXBP4, SUB1, SUCLG2, Survivin, SYT9, TFF3 (secreted), TGOLN2, THBS1, TIMP1, TIMP2, TMED10, TMED4, TMED9, TMEM211, TOM1, TRAF4 (scaffolding), TRAIL-R2, TRAP1, TrkB, Tsg 101, TXNDC16, U2AF2, UEVLD, UFC1, UNC93a, USP14, VASP, VCP, VDAC1, VEGFA, VEGFR1, VEGFR2, VPS37C, WIZ, XRCC5, XRCC6, YB-1, YWHAZ, or any combination thereof. In other embodiments, the target biomarker is selected from the group consisting of p53, p63, p73, mdm-2, procathepsin-D, B23, C23, PLAP, CA125, MUC-1, HER2, NY-ESO-1, SCP1, SSX-1, SSX-2, SSX-4, HSP27, HSP60, HSP90, GRP78, TAG72, HoxA7, HoxB7, EpCAM, ras, mesothelin, survivin, EGFK, MUC-1, or c-myc. The microvesicle antigen can be from any of Tables 18-26 or Table 45.

One of skill will appreciate that the above biomarker listings are not intended to be mutually exclusive. For example, a single target biomarker can have one or more of the following attributes: cancer/tumor antigen, cell antigen, microvesicle antigen, membrane antigen, and any combination thereof. In some embodiments, the target biomarker will have all of these attributes.

As noted above, the IDM domain can be constructed to illicit a complement mediated immune response that can induce apoptosis. Such IDM can include but are not limited to C1q, C1r, C1s, C1, C3a, C3b, C3d, C5a, C2, C4, and cytokines. The IDM region may comprise an oligonucleotide sequence including without limitation Toll-Like Receptor (TLR) agonists like CpG sequences which are immunostimulatory and/or polyG sequences which can be anti-proliferative or pro-apoptotic. The moiety can be vaccine like moiety or antigen that stimulates an immune response. In an embodiment, the immune stimulating moiety comprises a superantigen. In some embodiments, the superantigen can be selected from the group consisting of staphylococcal enterotoxins (SEs), a Streptococcus pyogenes exotoxin (SPE), a Staphylococcus aureus toxic shock-syndrome toxin (TSST-1), a streptococcal mitogenic exotoxin (SME), a streptococcal superantigen (SSA), a hepatitis surface antigen, or a combination thereof. Other bacterial antigens that can be used with the invention comprise bacterial antigens such as Freund's complete adjuvant, Freund's incomplete adjuvant, monophosphoryl-lipid A/trehalose dicorynomycolate (Ribi's adjuvant), BCG (Calmette-Guerin Bacillus; *Mycobacterium bovis*), and *Corynebacterium parvum*. The immune stimulating moiety can also be a non-specific immunostimulant, such as an adjuvant or other non-specific immunostimulator. Useful adjuvants comprise without limitation aluminium salts, alum, aluminium phosphate, aluminium hydroxide, squalene, oils, MF59, and AS03 ("Adjuvant System 03"). The adjuvant can be selected from the group consisting of Cationic liposome-DNA complex JVRS-100, aluminum hydroxide vaccine adjuvant, aluminum phosphate vaccine adjuvant, aluminum potassium sulfate adjuvant, Alhydrogel, ISCOM(s)™, Freund's Complete Adjuvant, Freund's Incomplete Adjuvant, CpG DNA Vaccine Adjuvant, Cholera toxin, Cholera toxin B subunit, Liposomes, Saponin Vaccine Adjuvant, DDA Adjuvant, Squalene-based Adjuvants, Etx B subunit Adjuvant, IL-12 Vaccine Adjuvant, LTK63 Vaccine Mutant Adjuvant, TiterMax Gold Adjuvant, Ribi Vaccine Adjuvant, Montanide ISA 720 Adjuvant, *Corynebacterium*-derived P40 Vaccine Adjuvant, MPL™ Adjuvant, AS04, AS02, Lipopolysaccharide Vaccine Adjuvant, Muramyl Dipeptide Adjuvant, CRL1005, Killed *Corynebacterium parvum* Vaccine Adjuvant, Montanide ISA 51, Bordetella pertussis component Vaccine Adjuvant, Cationic Liposomal Vaccine Adjuvant, Adamantylamide Dipeptide Vaccine Adjuvant, Arlacel A, VSA-3 Adjuvant, Aluminum vaccine adjuvant, Polygen Vaccine Adjuvant, Adjumer™, Algal Glucan, Bay R1005, Theramide®, Stearyl Tyrosine, Specol, Algammulin, Avridine®, Calcium Phosphate Gel, CTA1-DD gene fusion protein, DOC/Alum Complex, Gamma Inulin, Gerbu Adjuvant, GM-CSF, GMDP, Recombinant hIFN-gamma/Interferon-g, Interleukin-1β, Interleukin-2, Interleukin-7, Sclavo peptide, Rehydragel LV, Rehydragel HPA, Loxoribine, MF59, MTP-PE Liposomes, Murametide, Murapalmitine, D-Murapalmitine, NAGO, Non-Ionic Surfactant Vesicles, PMMA, Protein Cochleates, QS-21, SPT (Antigen Formulation), nanoemulsion vaccine adjuvant, AS03, Quil-A vaccine adjuvant, RC529 vaccine adjuvant, LTR192G Vaccine Adjuvant, *E. coli* heat-labile toxin, LT, amorphous aluminum hydroxyphosphate sulfate adjuvant, Calcium phosphate vaccine adjuvant, Montanide Incomplete Seppic Adjuvant, Imiquimod, Resiquimod, AF03, Flagellin, Poly(I:C), ISCOMATRIX®, Abisco-100 vaccine adjuvant, Albumin-heparin microparticles vaccine adjuvant, AS-2 vaccine adjuvant, B7-2 vaccine adjuvant, DHEA vaccine adjuvant, Immunoliposomes Containing Antibodies to Costimulatory Molecules, SAF-1, Sendai Proteoliposomes, Sendai-containing Lipid Matrices, Threonyl muramyl dipeptide (TMDP), Ty Particles vaccine adjuvant, Bupivacaine vaccine adjuvant, DL-PGL (Polyester poly (DL-lactide-co-glycolide)) vaccine adjuvant, IL-15 vaccine adjuvant, LTK72 vaccine adjuvant, MPL-SE vaccine adjuvant, non-toxic mutant E112K of Cholera Toxin mCT-E112K, and Matrix-S. Additional adjuvants that can be used with the multipartite constructs of the invention can be identified using the Vaxjo database. See Sayers S, Ulysse G, Xiang Z, and He Y. Vaxjo: a web-based vaccine adjuvant database and its application for analysis of vaccine adjuvants and their uses in vaccine development. Journal of Biomedicine and Biotechnology. 2012; 2012: 831486. Epub 2012 Mar. 13. PMID: 22505817; www.violinet.org/vaxjo/. Other useful non-specific immunostimulators comprise histamine, interferon, transfer factor, tuftsin, interleukin-1, female sex hormones, prolactin, growth hormone vitamin D, deoxycholic acid (DCA), tetrachlorodecaoxide (TCDO), and imiquimod or resiquimod, which are drugs that activate immune cells through the toll-like receptor 7. A multipartite construct can be created that comprises more than one immunomodulating moiety, e.g., using segments that span CpG sequences which are immunostimulatory with complement directed segments that can stimulate apoptosis.

Modifications

Modifications to the multipartite constructs can be made to alter desired characteristics, including without limitation in vivo stability, specificity, affinity, avidity or nuclease susceptibility. Alterations to the half life may improve stability in vivo or may reduce stability to limit in vivo toxicity. Such alterations can include mutations, truncations or extensions. The 5' and/or 3' ends of the multipartite oligonucleotide constructs can be protected or deprotected to modulate stability as well. Modifications to improve in vivo stability, specificity, affinity, avidity or nuclease susceptibility or alter the half life to influence in vivo toxicity may be at the 5' or 3' end and include but are not limited to the following: LNA incorporation, phosphorothioate backbone instead of phosphodiester backbone, amino modifiers (i.e. C6-dT), dye conjugates (Cy dues, Fluorophores, etc), Biotinylation, PEG linkers, Click chemistry linkers, dideoxynucleotide end blockers, inverted end bases, cholesterol TEG or other lipid based labels.

Linkage options for segments of the multipartite construct can be on the 5' or 3' end of an oligonucleotide or to a primary amine, sulfhydryl or carboxyl group of an antibody and include but are not limited to the following: Biotin-target oligonucleotide/Ab, streptavidin-complement oligonucleotide or vice versa, amino modified-target Ab/oligonucleotide, thiol/carboxy-complement oligonucleotide or vice versa, Click chemistry-target Ab/oligonucleotide, corresponding Click chemistry partner-complement oligonucleotide or vice versa. The linkages may be covalent or non-covalent and may include but are not limited to monovalent, multivalent (i.e. bi, tri or tetra-valent) assembly, to a DNA scaffold (i.e. DNA origami structure), drug/chemotherapeutic agent, nanoparticle, microparticle or a micelle or liposome.

A linker region can comprise a spacer with homo- or multifunctional reactive groups that can vary in length and type. These include but are not limited to the following: spacer C18, PEG4, PEG6, PEG8, and PEG12.

The multipartite oligonucleotide of the invention can further comprise additional elements to add desired biological effects. For example, the multipartite construct may comprise a membrane disruptive moiety. The multipartite construct may also be conjugated to one or more chemical moiety that provides such effects. For example, the multipartite construct may be conjugated to a detergent-like moiety to disrupt the membrane of a target cell or microvesicle. Useful ionic detergents include sodium dodecyl sulfate (SDS, sodium lauryl sulfate (SLS)), sodium laureth sulfate (SLS, sodium lauryl ether sulfate (SLES)), ammonium lauryl sulfate (ALS), cetrimonium bromide, cetrimonium chloride, cetrimonium stearate, and the like. Useful non-ionic (zwitterionic) detergents include polyoxyethylene glycols, polysorbate 20 (also known as Tween 20), other polysorbates (e.g., 40, 60, 65, 80, etc), Triton-X (e.g., X100, X114), 3-[(3-cholamidopropyl)dimethylammonio]-1-propanesulfonate (CHAPS), CHAPSO, deoxycholic acid, sodium deoxycholate, NP-40, glycosides, octyl-thio-glucosides, maltosides, and the like. One of skill will appreciate that functional fragments, such as membrane disruptive moieties, can be covalently or non-covalently attached to the multipartite construct.

Oligonucleotide segments of a multipartite construct can include any desirable base modification known in the art. In certain embodiments, oligonucleotide segments are 10 to 50 nucleotides in length. One having ordinary skill in the art will appreciate that this embodies oligonucleotides of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length, or any range derivable there within.

In certain embodiments, a multipartite construct comprises a chimeric oligonucleotide that contains two or more chemically distinct regions, each made up of at least one nucleotide. Such chimeras can be referred to using terms such as multipartite, multivalent, or the like. The oligonucleotides portions may contain at least one region of modified nucleotides that confers one or more beneficial properties, e.g., increased nuclease resistance, bioavailability, increased binding affinity for the target. Chimeric nucleic acids of the invention may be formed as composite structures of two or more oligonucleotides, two or more types of oligonucleotides (e.g., both DNA and RNA segments), modified oligonucleotides, oligonucleosides and/or oligonucleotide mimetics. Such compounds have also been referred to in the art as hybrids. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference in its entirety.

In certain embodiments, a multipartite construct comprises at least one nucleotide modified at the 2' position of the sugar, including without limitation a 2'-O-alkyl, 2'-O-alkyl-O-alkyl or 2'-fluoro-modified nucleotide. In other embodiments, RNA modifications include 2'-fluoro, 2'-amino and 2' O-methyl modifications on the ribose of pyrimidines, a basic residue or an inverted base at the 3' end of the RNA. Such modifications are routinely incorporated into oligonucleotides and these oligonucleotides have been shown to have higher target binding affinity in some cases than 2'-deoxyoligonucleotides against a given target.

A number of nucleotide and nucleoside modifications have been shown to make an oligonucleotide more resistant to nuclease digestion, thereby prolonging in vivo half-life. Specific examples of modified oligonucleotides include those comprising backbones comprising, for example, phosphorothioates, phosphotriesters, methyl phosphonates, short chain alkyl or cycloalkyl intersugar linkages or short chain heteroatomic or heterocyclic intersugar linkages. The constructs of the invention can comprise oligonucleotides with phosphorothioate backbones and/or heteroatom backbones, e.g., CH2-NH—O—CH2, CH, ~N(CH3)~0~CH2 (known as a methylene(methylimino) or MMI backbone], CH2-O—N(CH3)-CH2, CH2-N(CH3)-N(CH3)-CH2 and O—N(CH3)-CH2-CH2 backbones, wherein the native phosphodiester backbone is represented as O—P—O—CH,); amide backbones (De Mesmaeker et ah, 1995); morpholino backbone structures (Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone (Nielsen, et al., 1991), each of which is herein incorporated by reference in its entirety. Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3*-5* to 5*-3* or 2*-5* to 5*-2*; see U.S. Pat. Nos. 3,687,808; 4,469,863; 4,476,301; 5,023,243; 5, 177,196; 5,188,897; 5,264,423; 5,276,019; 5,278,302; 5,286,717; 5,321, 131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050, each of which is herein incorporated by reference in its entirety. Morpholino-based oligomeric compounds are known in the art described in Braasch & Corey, Biochemistry vol. 41, no. 14, 2002, pages 4503-4510; Genesis vol. 30, 2001, page 3; Heasman, J. Dev. Biol. vol. 243, 2002, pages 209-214; Nasevicius et al. Nat. Genet. vol. 26, 2000, pages 216-220; Lacerra et al. Proc. Natl. Acad. Sci. vol. 97, 2000, pages 9591-9596 and U.S. Pat. No. 5,034,506, issued Jul. 23, 1991, each of which is herein incorporated by reference in its entirety. Cyclohexenyl nucleic acid oligonucleotide mimetics are described in Wang et al., J. Am. Chem. Soc. Vol. 122, 2000, pages 8595-8602, the contents of which is incorporated herein in its entirety. A multipartite construct of the invention can comprise at least such modification as desired.

Modified oligonucleotide backbones that do not include a phosphorus atom therein have backbones that can be formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts; see U.S. Pat. Nos. 5,034,506; 5,166,315; 5,185,444; 5,214,134; 5,216, 141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference in its entirety. A multipartite construct of the invention can comprise at least such modification as desired.

In certain embodiments, a multipartite construct comprises one or more substituted sugar moieties, e.g., one of the following at the 2' position: OH, SH, $SCH_3$, F, OCN, $OCH_3OCH_3$, $OCH_3O(CH_2)n$ $CH_3$, $O(CH_2)n$ $NH_2$ or $O(CH_2)n$ $CH_3$ where n is from 1 to about 10; Ci to CIO lower alkyl, alkoxyalkoxy, substituted lower alkyl, alkaryl or aralkyl; CI; Br; CN; $CF_3$; $OCF_3$; O-, S-, or N-alkyl; O-, S-, or N-alkenyl; $SOCH_3$; $SO_2CH_3$; $ONO_2$; $NO_2$; $N_3$; $NH_2$; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacokinetic/pharmacodynamic properties of an oligonucleotide and other substituents having similar properties. A preferred modification includes 2'-methoxyethoxy [2'-0-CH2CH2OCH3, also known as 2'-0-(2-methoxyethyl)]. Other preferred modifications include 2*-methoxy (2*-0-CH3), 2*-propoxy (2*-OCH2 CH2CH3) and 2*-fluoro (2*-F). Similar modifications may also be made at other positions on the oligonucleotide, e.g., the 3' position of the sugar on the 3' terminal nucleotide and the 5' position of 5' terminal nucleotide. Oligonucleotides may also have sugar mimetics such as cyclobutyls in place of the pentofuranosyl group.

In certain embodiments, a multipartite construct of the invention comprises one or more base modifications and/or substitutions. As used herein, "unmodified" or "natural" bases include adenine (A), guanine (G), thymine (T), cytosine (C) and uracil (U). Modified bases include, without limitation, bases found only infrequently or transiently in natural nucleic acids, e.g., hypoxanthine, 6-methyladenine, 5-Me pyrimidines, particularly 5-methylcytosine (also referred to as 5-methyl-2' deoxy cytosine and often referred to in the art as 5-Me-C), 5-hydroxymethylcytosine (HMC), glycosyl HMC and gentobiosyl HMC, as well as synthetic bases, e.g., 2-aminoadenine, 2-(methylamino)adenine, 2-(imidazolylalkyl)adenine, 2-(aminoalklyamino)adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl)adenine and 2,6-diaminopurine (Kornberg, 1980; Gebeyehu, et ah, 1987). A "universal" base known in the art, e.g., inosine, can also be included. 5-Me-C substitutions can also be included. These have been shown to increase nucleic acid duplex stability by 0.6-1.20 C. See, e.g., Sanghvi et al., 'Antisense Research & Applications', 1993, CRC PRESS pages 276-278. Further suitable modified bases are described in U.S. Pat. Nos. 3,687,808, as well as 4,845,205; 5,130,302; 5,134,066; 5,175, 273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

It is not necessary for all positions in a given oligonucleotide to be uniformly modified, and in fact more than one of the aforementioned modifications may be incorporated in a single oligonucleotide or even at within a single nucleoside within an oligonucleotide.

In certain embodiments, both a sugar and an internucleoside linkage, i.e., the backbone, of one or more nucleotide units within a multipartite construct are replaced with novel groups. The base can be maintained for hybridization with an appropriate nucleic acid target compound. One such oligomeric compound, an oligonucleotide mimetic that has been shown to retain hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative patents that teach the preparation of PNA compounds comprise, but are not limited to, U.S. Pat. Nos. 5,539,082; 5,714,331; and 5,719, 262, each of which is herein incorporated by reference. Further teaching of PNA compounds can be found in Nielsen et al. Science vol. 254, 1991, page 1497, which is herein incorporated by reference.

In certain embodiments, the multipartite construct is linked (covalently or non-covalently) to one or more moieties or conjugates that enhance activity, cellular distribution, or localization. Such moieties include, without limitation, lipid moieties such as a cholesterol moiety (Letsinger et al. Proc. Natl. Acad. Sci. Usa. vol. 86, 1989, pages 6553-6556), cholic acid (Manoharan et al. Bioorg. Med. Chem. Let. vol. 4, 1994, pages 1053-1060), a thioether, e.g., hexyl-S-tritylthiol (Manoharan et al. Ann. N. Y. Acad. Sci. Vol. 660, 1992, pages 306-309; Manoharan et al. Bioorg. Med. Chem. Let. vol. 3, 1993, pages 2765-2770), a thiocholesterol (Oberhauser et al. Nucl. Acids Res. vol. 20, 1992, pages 533-538), an aliphatic chain, e.g., dodecandiol or undecyl residues (Kabanov et al. Febs Lett. vol. 259, 1990, pages 327-330; Svinarchuk et al. Biochimie. vol. 75, 1993, pages 49-54), a phospholipid, e.g., di-hexadecyl-rac-glycerol or triethylammonium 1,2-di-O-hexadecyl-rac-glycero-3-H-phosphonate (Manoharan et al. Tetrahedron Lett. vol. 36, 1995, pages 3651-3654; Shea et al. Nucl. Acids Res. vol. 18, 1990, pages 3777-3783), a polyamine or a polyethylene glycol chain (Mancharan et al. Nucleosides & Nucleotides vol. 14, 1995, pages 969-973), or adamantane acetic acid (Manoharan et al. Tetrahedron Lett. vol. 36, 1995, pages 3651-3654), a palmityl moiety (Mishra et al. Biochim. Biophys. Acta vol. 1264, 1995, pages 229-237), or an octadecylamine or hexylamino-carbonyl-t oxycholesterol moiety (Crooke et al. J. Pharmacol. Exp. Ther. vol. 277, 1996, pages 923-937), each of which is herein incorporated by reference in its entirety. See also U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference in its entirety.

The multipartite construct of the invention can be modified to incorporate a wide variety of modified nucleotides as desired. For example, the construct may be synthesized entirely of modified nucleotides or with a subset of modified nucleotides. The modifications can be the same or different. Some or all nucleotides may be modified, and those that are modified may contain the same modification. For example, all nucleotides containing the same base may have one type of modification, while nucleotides containing other bases may have different types of modification. All purine nucleotides may have one type of modification (or are unmodified), while all pyrimidine nucleotides have another, different type of modification (or are unmodified). Thus, the construct may comprise any combination of desired modifications, including for example, ribonucleotides (2'-OH), deoxyribonucleotides (2'-deoxy), 2'-amino nucleotides (2'-NH2), 2'-fluoro nucleotides (2'-F) and 2'-0-methyl (2'-OMe) nucleotides.

In some embodiments, the multipartite construct is synthesized using a transcription mixture containing modified nucleotides in order to generate a modified construct. For example, a transcription mixture may contain only 2'-OMe A, G, C and U and/or T triphosphates (2'-OMe ATP, 2'-OMe UTP and/or 2*-OMe TTP, 2*-OMe CTP and 2*-OMe GTP), referred to as an MNA or mRmY mixture. Oligonucleotides generated therefrom are referred to as MNA oligonucleotides or mRmY oligonucleotides and contain only 2'-0-methyl nucleotides. A transcription mixture containing all 2'-OH nucleotides is referred to as an "rN" mixture, and oligonucleotides generated therefrom are referred to as "rN", "rRrY" or RNA oligonucleotides. A transcription mixture containing all deoxy nucleotides is referred to as a "dN" mixture, and oligonucleotides generated therefrom are referred to as "dN", "dRdY" or DNA oligonucleotides. Alternatively, a subset of nucleotides (e.g., C, U and/or T) may comprise a first modified nucleotides (e.g., 2'-OMe) nucleotides and the remainder (e.g., A and G) comprise a second modified nucleotide (e.g., 2'-OH or 2'-F). For example, a transcription mixture containing 2'-F U and 2'-OMe A, G and C is referred to as a "fUmV" mixture, and oligonucleotides generated therefrom are referred to as "fUmV" oligonucleotides. A transcription mixture containing 2'-F A and G, and 2'-OMe C and U and/or T is referred to as an "fRmY" mixture, and oligonucleotides generated therefrom are referred to as "fRmY" oligonucleotides. A transcription mixture containing 2'-F A and 2'-OMe C, G and U and/or T is referred to as "fAmB" mixture, and oligonucleotides generated therefrom are referred to as "fAmB" oligonucleotides.

One of skill in the art can improve pre-identified aptamer segments (e.g., variable regions or immunomodulatory regions that comprise an aptamer to a biomarker target or other entity) using various process modifications. Examples of such process modifications include, but are not limited to, truncation, deletion, substitution, or modification of a sugar or base or internucleotide linkage, capping, and PEGylation. In addition, the sequence requirements of an aptamer may be explored through doped reselections or aptamer medicinal chemistry. Doped reselections are carried out using a synthetic, degenerate pool that has been designed based on the aptamer of interest. The level of degeneracy usually varies from about 70-85% from the aptamer of interest. In general, sequences with neutral mutations are identified through the doped reselection process. Aptamer medicinal chemistry is an aptamer improvement technique in which sets of variant aptamers are chemically synthesized. These variants are then compared to each other and to the parent aptamer. Aptamer medicinal chemistry is used to explore the local, rather than global, introduction of substituents. For example, the following modifications may be introduced: modifications at a sugar, base, and/or internucleotide linkage, such as 2'-deoxy, 2'-ribo, or 2'-0-methyl purines or pyrimidines, phosphorothioate linkages may be introduced between nucleotides, a cap may be introduced at the 5' or 3' end of the aptamer (such as 3' inverted dT cap) to block degradation by exonucleases, or a polyethylene glycol (PEG) element may be added to the aptamer to increase the half-life of the aptamer in the subject.

Additional compositions comprising a multipartite construct of the invention and uses thereof are further described below.

Personalized Multipartite Constructs

Figure 23D:
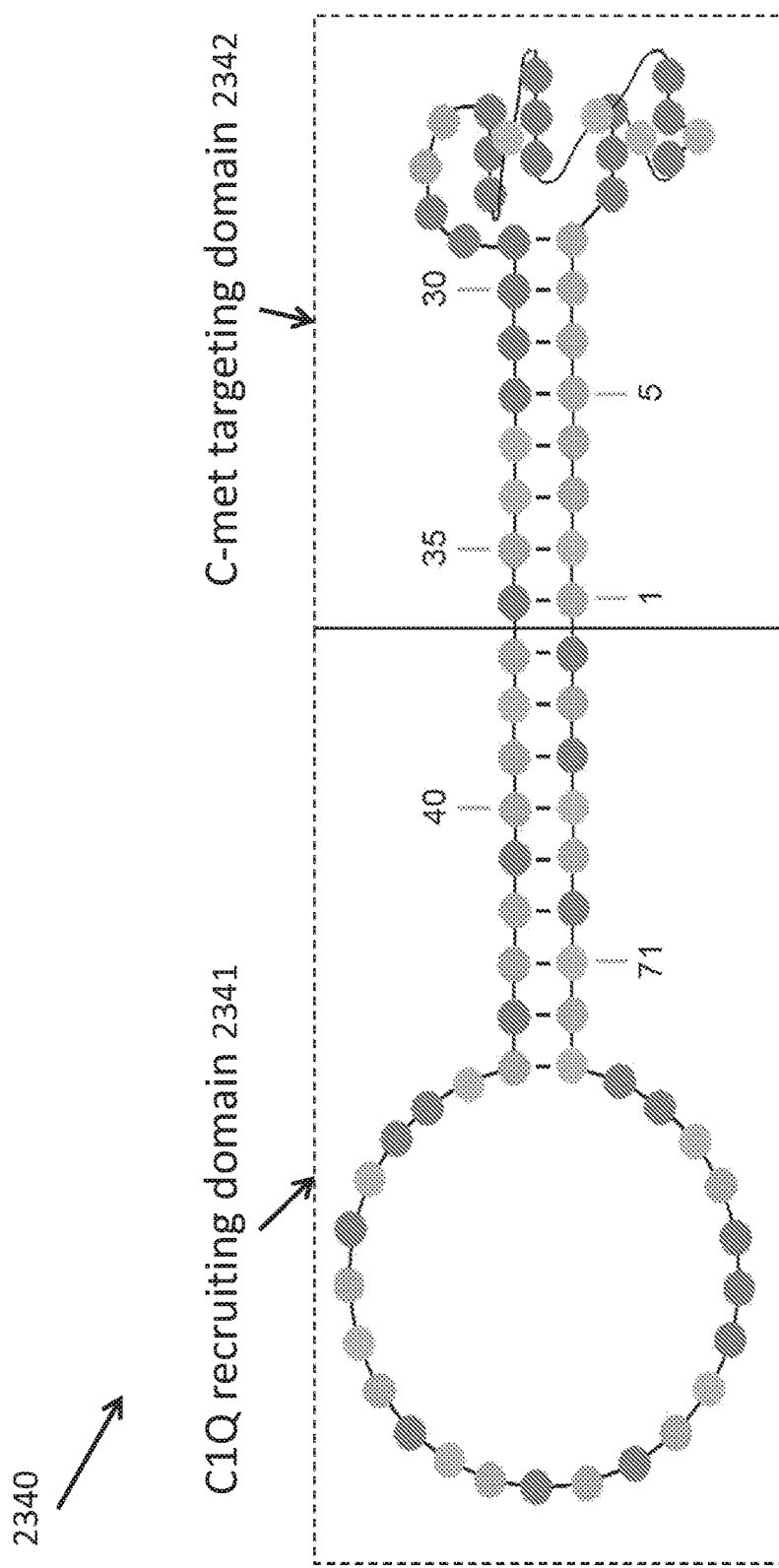
Figure 23E:
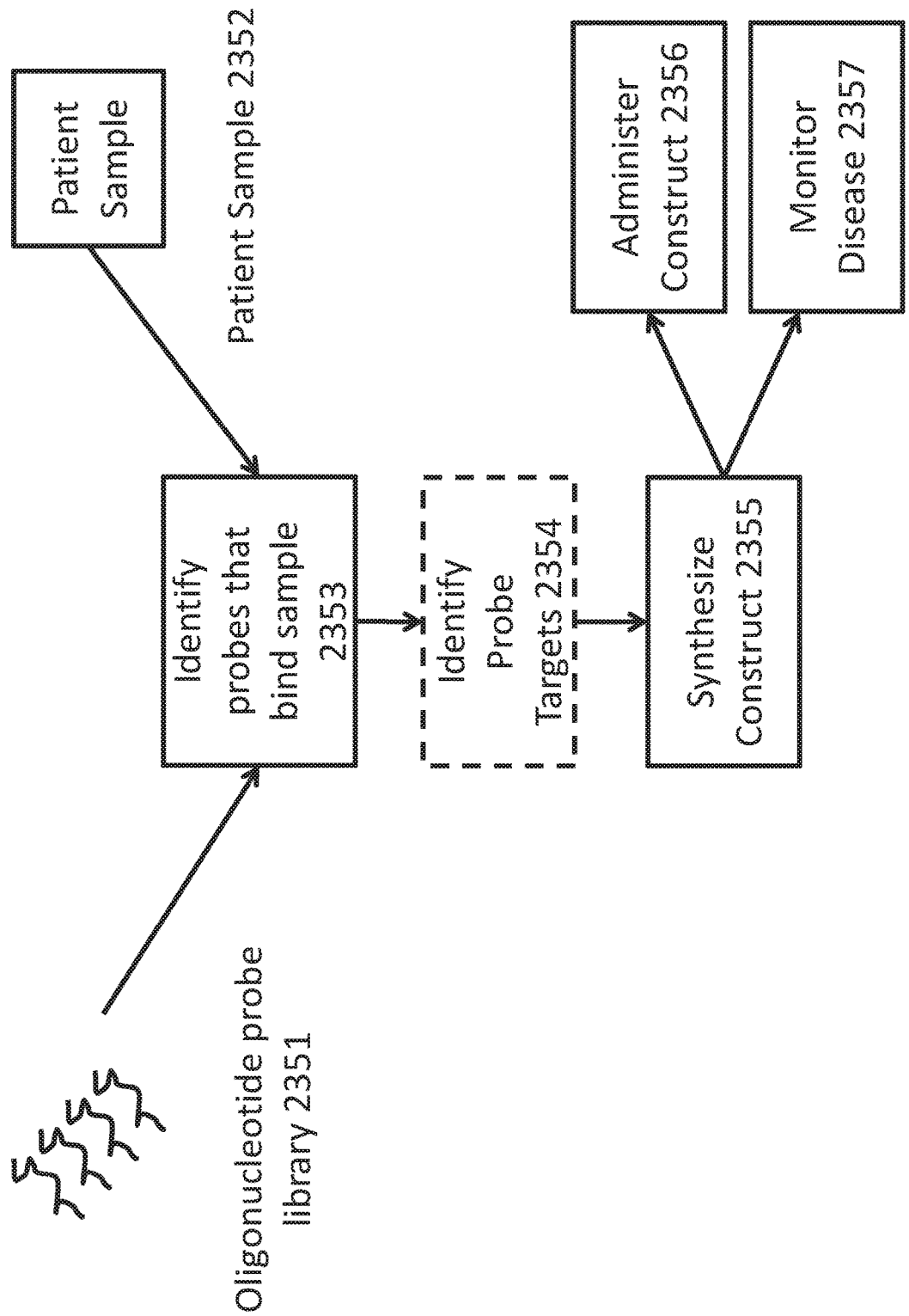

The oligonucleotide probe libraries of the invention can be used to construct personalized multipartite constructs. As an example, an oligonucleotide probe library can be used to probe a sample from a patient. The biomarker targets are identified for library members that preferentially recognize diseased cells, e.g., cancer cells, from the individual. Such methodology is described herein. See, e.g., Example 23. The variable region of one or more oligonucleotide probe to the patient's diseased cells is used to synthesize a multipartite construct of the invention. Such construct can be used as a personalized treatment for the patient. FIG. 23E illustrates a flow chart of this approach. An oligonucleotide probe library 2351 is contacted with patient sample 2352. The sample can be any useful patient sample, including without limitation tissue such as biopsy or tissue removed during surgical or other procedures, bodily fluids, frozen sections taken for histological purposes, cell cultures, and various embodiments, fractions, and components of any thereof as described herein. See, e.g., section entitled "Samples" above. Oligonucleotide probes that bind the patient sample are identified 2353. Methodology for identifying oligonucleotide probe members that bind a biological sample is described herein, and includes without limitation sequence analysis such as next generation sequencing, amplification and/or hybridization approaches. In an embodiment, flow sorting is used to separate diseased cells from the contacted patient sample and sorted and bound oligonucleotides are identified 2353. In an optional step, the biomarkers recognized by the oligonucleotide probe binders are identified 2354. This step can be optional as the target biomarker of a disease-specific oligonucleotide probe may not be necessary to synthesize a multipartite construct specific for the patient's disease. However, the identification of the target may assist in design of the multipartite construct. For example, identification of the target may allow computer modeling of the construct's in vivo interactions or help to select the most promising probe from multiple candidates, e.g., by avoiding toxicity associated with non-disease specific targets. The oligonucleotide probe binders are used to create a multipartite construct of the invention 2355. The multipartite construct can be as shown in FIG. 23A or variants thereof. In an embodiment, the variable region of an oligonucleotide probe binder is used as the variable region as shown in FIG. 23A. The multipartite construct can be administered to the patient 2356, thereby providing a personalized therapy for the patient. Further as noted in the figure, constructs comprising the variable region of an oligonucleotide probe binder can be used for other purposes, such as disease monitoring 2357. As an example of such methodology, the oligonucleotide probe binder can be used to detect the presence or absence of disease markers in the patient over time such as in an immunoassay format.

Anti-C1q Oligonucleotides

The complement system is a part of the immune system that enhances (complements) the ability of antibodies and phagocytic cells to clear microbes and damaged cells from an organism. It is part of the innate immune system, which is not adaptable and does not change over the course of an individual's lifetime. However, it can be recruited and brought into action by the adaptive immune system. Complement activation or fixation can stimulate phagocytes to clear foreign and damaged material, induce inflammation to attract additional phagocytes, and activate the cell-killing membrane attack complex. The "classical" complement pathway is triggered by activation of the C1-complex, which occurs when C1q binds to IgM or IgG complexed with antigens. The C1-complex is composed of 1 molecule of C1q, 2 molecules of C1r and 2 molecules of C1s, or $C1qr_2s_2$. Such immunoglobulin-mediated binding of the complement uses the ability of the immunoglobulin system to detect and bind to non-self antigens. C1q can also directly identify various structures and ligands on microbial surfaces and apoptotic cells, and binds additional self proteins including C-reactive protein (CRP), HIV-1, phosphatidylserine (PS), HTLV-1, and others. Because the complement system has the potential to be extremely damaging to host tissues, its activation must be tightly regulated. The classical pathway is inhibited by C1-inhibitor, which binds to C1 to prevent its activation. C1q also performs a number of non-complement functions, including without limitation such diverse functions as clearance of bacterial pathogens, induction of angiogenesis during wound healing, tolerance induction, anti-inflammatory responses and inhibiting T cell response. As a result of these diverse functions, complement and C1q play a role in diverse diseases and disorders, including without limitation autoimmune settings, pregnancy disorders, pathogen infection, aggregated proteins leading to neurodegenerative diseases, inflammation, and cancer. Deficiencies have been associated with autoimmune disease (e.g., systemic lupus erythematosus), pathogen infection and cancer. However, the tumor microenvironment may also hijack C1q to promote cell adhesion, migration and proliferation. See, e.g., Kouser et al., Emerging and Novel Functions of Complement Protein C1q, Front Immunol. 2015; 6: 317. Published online 2015 Jun. 29; Son et al., Fundamental role of C1q in autoimmunity and inflammation, Immunol Res. 2015 December; 63(1-3): 101-106; Ghebrehiwet et al., The C1q Family of Proteins: Insights into the Emerging Non-Traditional Functions, Front Immunol. 2012; 3: 52; Nayak et al., Complement and non-complement activating functions of C1q: a prototypical innate immune molecule. Innate Immun. 2012 April; 18(2):350-63.

C1q is a Ca2+ dependent hexameric complex comprised of 18 polypeptide chains, 6 of three different subunits (C1q A chain (P02745), C1q B chain (P02746), and C1q C chain (P02747)), that binds C1r and C1s to form the C1 complex, the first component in classical pathway of complement. C1q globular heads form a pattern recognition complex that binds to various targets, including without limitation clustered antigen-antibody Fc immune complexes (e.g., IgG, IgM), C-reactive protein (CRP), abnormal proteins (e.g., prion and beta-amyloid), apoptotic and secondary necrotic cells, phosphatidylserine and the surface of a subpopulation of microparticles in human plasma. Recognition of IgG and IgM on a cell surface can induce a complement cascade and lead to apoptosis. See, e.g., Kishore et al., C1q and tumor necrosis factor superfamily: modularity and versatility, TRENDS in Immunology 25 (2004) 551-561; Nayak et al., Complement and non-complement activating functions of C1q: a prototypical innate immune molecule, Innate Immunity 18 (2012) 350-363. Aptamer-biotin-C1q protein conjugates have been used to induce complement mediated cell death. See, e.g., Bruno, Aptamer-biotin-streptavidin-C1q complexes can trigger the classical complement pathway to kill cancer cells, In Vitro Cell Dev Biol—Animal (2010) 46:107-113.

C1q globular heads has been shown to bind DNA and recognize apoptotic cells. See, e.g., Païdassi et al., The lectin-like activity of human C1q and its implication in DNA and apoptotic cell recognition, FEBS Letters 582 (2008) 3111-3116; Navratil et al., The globular heads of C1q specifically recognize surface blebs of apoptotic vascular endothelial cells, J Immunol 166 (2001) 3231-3239. DNA binds C1qA and activates the complement cascade without interfering with the ability of C1q to bind antibody Fc regions. See, e.g., Jiang et al., DNA binds and activates complement via residues 14-26 of the human C1q A chain, J Biol Chem 267 (1992) 25597-25601; Garlatti, et al. Cutting edge: C1q binds deoxyribose and heparan sulfate through neighboring sites of its recognition domain, J Immunol 185 (2010) 808-812.

C1q protein quantification has been used for disease monitoring and monoclonal antibody (mAb) production. For example, C1q mAb is used to coat ELISA plates to capture and quantitate immune complexes in clinical samples. Various companies sell diagnostic kits for immune complex detection and quantitation which are based on the ability of C1q to bind well to immune complexes, but to not bind significantly to monomeric immunoglobulins. Because the DNA recognition domain of C1q does not overlap with the Fc-recognition domain, a DNA based ELISA may further allow a more accurate quantitation of immune complex detection.

Example 35 herein presents identification of an anti-C1q oligonucleotide aptamers and describes various uses thereof. The aptamers to C1q were identified via oligonucleotide probe analysis of plasma microvesicles followed by identification of oligonucleotide probe targets using gel electrophoresis and mass spectrometry analysis.

Anti-C1q aptamers of the invention can be used for multiple purposes. As described above, the invention provides a multipartite construct having a disease specific target oligonucleotide or antibody (Ab) that can recognize a target of interest and an immunomodulatory region. In an embodiment of the invention, the immunomodulatory region comprises the C1q aptamer. Such construct can act as an immunotherapeutic agent for targeted cell killing via recruitment of complement proteins and the downstream membrane attack complex (MAC). By linking the C1q aptamer segment to another segment that specifically binds to a target of interest (e.g., a biomarker present on a cell or microvesicle of interest), the construct can bring C1q into proximity of a target. See FIG. 23C, which illustrates a construct 2331 having a segment that recognizes a Marker of Interest 2332 on a Membrane 2333, and another segment that attracts the Complement system 2334. Such binding can cause a complement cascade and induce complement mediated cell killing. This approach can be applied in multiple setting, e.g., to recognize cancer cells, gram negative bacteria, and/or viral and/or parasitic infections. For example, an anti-CD20 specific oligonucleotide can be linked with an anti-C1q specific oligonucleotide. The linkage to create the oligonucleotide-oligonucleotide construct can include but is not limited to direct synthesis with a spacer between the two oligonucleotide recognition sites. Different biomarkers can be used as the target of interest, thereby directing the complement cascade to the various targets as desired. The spacer type and size can be configured based on steric hindrance between the target protein and the C1q protein/MAC complex. As noted above, the target specific oligonucleotides/Abs can be chosen to specially recognize various targets of interest, including but not limited to cancer cells, circulating tumor cells, immune cells (e.g., B-cells, T-cells, neutrophils, macrophage, dendritic cells) microvesicles, bacteria, viruses or parasites. In addition to C1q, the target of the complement specific oligonucleotide segment can include without limitation C1r, C1s, C1, C3a, C3b, C3d, C5a, C2, C4, and cytokines.

The multipartite construct of the invention can comprise a linear molecule, a circular molecule, and/or adopt various secondary structures. FIG. 23D illustrates a construct 2340 having a C1q recruiting domain 2341 (nucleotides 37-77) and a C-met targeting domain 2342 (nucleotides 1-36). As desired, the C1q recruiting domain 2341 can comprise an anti-C1q oligonucleotide sequence of the invention. See e.g., Example 35. As shown in the illustration, the C1q recruiting domain 2341 comprises a single stranded hairpin and a complementary base pairing region, and the C-met targeting domain 2342 comprises a complementary base pairing region and a region having a more complex secondary structure. Such structures can be estimated using available software programs such as Vienna or mfold (available at mfold.rit.albany.edu). Such structural estimates can also be used to design derivatives of the sequences, e.g., by substituting, adding or deleting nucleotides in order to increase or decrease melting temperature, facilitate additions of non-natural nucleotide analogs, direct chemical modification, and/or manipulate structure or other parameters.

The invention further provides a method of molecular profiling of patient specific autoantigens by identifying autoantigens bound to complement 1 (C1) in plasma. The invention also provides immunoassays that detect levels of C1q protein. Such assays can be any applicable immunoassay format using the anti-C1q oligonucleotide of the invention, including without limitation an oligonucleotide based ELISA, Western analysis, flow cytometry, or affinity isolation. The immunoassay can be applied to various settings, including without limitation: 1) monitor cancer patient specific immune responses before, during and after administration of immunosuppressing drugs for optimal treatment with chemotherapeutic agents; 2) monitor immune responses in patients with autoimmune disorders in response to administration of immunosuppressing drugs such as TNF blockers; 3) detect levels of C1q and/or anti-C1q autoantibodies in patients with systemic lupus erythematosus (SLE); 4) quantitative C1q assay for mAb biosimilar production to satisfy the EMA biosimilar antibody guidance measures; 5) a WHO secondary test as a companion test to mAb based ELISAs; 6) as a marker for apoptosis/secondary necrosis; and 7) a C1q test for research purposes.

Pharmaceutical Compositions

In an aspect, the invention provides pharmaceutical compositions comprising the multipartite constructs of the invention as described above. The invention further provides methods of administering such compositions.

The term "condition," as used herein means an interruption, cessation, or disorder of a bodily function, system, or organ. Representative conditions include, but are not limited to, diseases such as cancer, inflammation, diabetes, and organ failure.

The phrase "treating," "treatment of," and the like include the amelioration or cessation of a specified condition.

The phrase "preventing," "prevention of," and the like include the avoidance of the onset of a condition.

The term "salt," as used herein, means two compounds that are not covalently bound but are chemically bound by ionic interactions.

The term "pharmaceutically acceptable," as used herein, when referring to a component of a pharmaceutical composition means that the component, when administered to an animal, does not have undue adverse effects such as excessive toxicity, irritation, or allergic response commensurate with a reasonable benefit/risk ratio. Accordingly, the term "pharmaceutically acceptable organic solvent," as used herein, means an organic solvent that when administered to an animal does not have undue adverse effects such as excessive toxicity, irritation, or allergic response commensurate with a reasonable benefit/risk ratio. Preferably, the pharmaceutically acceptable organic solvent is a solvent that is generally recognized as safe ("GRAS") by the United States Food and Drug Administration ("FDA"). Similarly, the term "pharmaceutically acceptable organic base," as used herein, means an organic base that when administered to an animal does not have undue adverse effects such as excessive toxicity, irritation, or allergic response commensurate with a reasonable benefit/risk ratio.

The phrase "injectable" or "injectable composition," as used herein, means a composition that can be drawn into a syringe and injected subcutaneously, intraperitoneally, or intramuscularly into an animal without causing adverse effects due to the presence of solid material in the composition. Solid materials include, but are not limited to, crystals, gummy masses, and gels. Typically, a formulation or composition is considered to be injectable when no more than about 15%, preferably no more than about 10%, more preferably no more than about 5%, even more preferably no more than about 2%, and most preferably no more than about 1% of the formulation is retained on a 0.22 µm filter when the formulation is filtered through the filter at 98° F. There are, however, some compositions of the invention, which are gels, that can be easily dispensed from a syringe but will be retained on a 0.22 µm filter. In one embodiment, the term "injectable," as used herein, includes these gel compositions. In one embodiment, the term "injectable," as used herein, further includes compositions that when warmed to a temperature of up to about 40° C. and then filtered through a 0.22 µm filter, no more than about 15%, preferably no more than about 10%, more preferably no more than about 5%, even more preferably no more than about 2%, and most preferably no more than about 1% of the formulation is retained on the filter. In one embodiment, an example of an injectable pharmaceutical composition is a solution of a pharmaceutically active compound (for example, a multipartite construct) in a pharmaceutically acceptable solvent. One of skill will appreciate that injectable solutions have inherent properties, e.g., sterility, pharmaceutically acceptable excipients and free of harmful measures of pyrogens or similar contaminants.

The term "solution," as used herein, means a uniformly dispersed mixture at the molecular or ionic level of one or more substances (solute), in one or more other substances (solvent), typically a liquid.

The term "suspension," as used herein, means solid particles that are evenly dispersed in a solvent, which can be aqueous or non-aqueous.

The term "animal," as used herein, includes, but is not limited to, humans, canines, felines, equines, bovines, ovines, porcines, amphibians, reptiles, and avians. Representative animals include, but are not limited to a cow, a horse, a sheep, a pig, an ungulate, a chimpanzee, a monkey, a baboon, a chicken, a turkey, a mouse, a rabbit, a rat, a guinea pig, a dog, a cat, and a human. In one embodiment, the animal is a mammal. In one embodiment, the animal is a human. In one embodiment, the animal is a non-human. In one embodiment, the animal is a canine, a feline, an equine, a bovine, an ovine, or a porcine.

The phrase "drug depot," as used herein means a precipitate, which includes the multipartite construct, formed within the body of a treated animal that releases the multipartite construct over time to provide a pharmaceutically effective amount of the multipartite construct.

The phrase "substantially free of," as used herein, means less than about 2 percent by weight. For example, the phrase "a pharmaceutical composition substantially free of water" means that the amount of water in the pharmaceutical composition is less than about 2 percent by weight of the pharmaceutical composition.

The term "effective amount," as used herein, means an amount sufficient to treat or prevent a condition in an animal.

The nucleotides that make up the multipartite construct can be modified to, for example, improve their stability, i.e., improve their in vivo half-life, and/or to reduce their rate of excretion when administered to an animal. The term "modified" encompasses nucleotides with a covalently modified base and/or sugar. For example, modified nucleotides include nucleotides having sugars which are covalently attached to low molecular weight organic groups other than a hydroxyl group at the 3' position and other than a phosphate group at the 5' position. Modified nucleotides may also include 2' substituted sugars such as 2'-O-methyl-; 2'-O-alkyl; 2'-O-allyl; 2'-S-alkyl; 2'-S-allyl; 2'-fluoro-; 2'-halo or 2'-azido-ribose; carbocyclic sugar analogues; a-anomeric sugars; and epimeric sugars such as arabinose, xyloses or lyxoses, pyranose sugars, furanose sugars, and sedoheptulose.

Modified nucleotides are known in the art and include, but are not limited to, alkylated purines and/or pyrimidines; acylated purines and/or pyrimidines; or other heterocycles. These classes of pyrimidines and purines are known in the art and include, pseudoisocytosine; N4,N4-ethanocytosine; 8-hydroxy-N6-methyladenine; 4-acetylcytosine, 5-(carboxyhydroxylmethyl) uracil; 5-fluorouracil; 5-bromouracil; 5-carboxymethylaminomethyl-2-thiouracil; 5-carboxymethylaminomethyl uracil; dihydrouracil; inosine; N6-isopentyladenine; 1-methyladenine; 1-methylpseudouracil; 1-methylguanine; 2,2-dimethylguanine; 2-methyladenine; 2-methylguanine; 3-methylcytosine; 5-methylcytosine; N6-methyladenine; 7-methylguanine; 5-methylaminomethyl uracil; 5-methoxy amino methyl-2-thiouracil; β-D-mannosylqueosine; 5-methoxycarbonylmethyluracil; 5-methoxyuracil; 2 methylthio-N6-isopentenyladenine; uracil-5-oxyacetic acid methyl ester; psueouracil; 2-thiocytosine; 5-methyl-2 thiouracil, 2-thiouracil; 4-thiouracil; 5-methyluracil; N-uracil-5-oxyacetic acid methylester; uracil 5-oxyacetic acid; queosine; 2-thiocytosine; 5-propyluracil; 5-propylcytosine; 5-ethyluracil; 5-ethylcytosine; 5-butyluracil; 5-pentyluracil; 5-pentylcytosine; and 2,6,-diaminopurine; methylpsuedouracil; 1-methylguanine; and 1-methylcytosine.

The multipartite construct can also be modified by replacing one or more phosphodiester linkages with alternative linking groups. Alternative linking groups include, but are not limited to embodiments wherein P(O)O is replaced by P(O)S, P(S)S, P(O)NR2, P(O)R, P(O)OR', CO, or CH2, wherein each R or R' is independently H or a substituted or unsubstituted C1-C20 alkyl. A preferred set of R substitutions for the P(O)NR2 group are hydrogen and methoxyethyl. Linking groups are typically attached to each adjacent nucleotide through an —O— bond, but may be modified to include —N— or —S— bonds. Not all linkages in an oligomer need to be identical.

The multipartite construct can also be modified by conjugating the multipartite construct to a polymer, for example, to reduce the rate of excretion when administered to an animal. For example, the multipartite construct can be "PEGylated," i.e., conjugated to polyethylene glycol ("PEG"). In one embodiment, the PEG has an average molecular weight ranging from about 20 kD to 80 kD. Methods to conjugate an oligonucleotide with a polymer, such PEG, are well known to those skilled in the art (See, e.g., Greg T. Hermanson, Bioconjugate Techniques, Academic Press, 1966).

The multipartite constructs of the invention, e.g., such as described above, can be used in the pharmaceutical compositions disclosed herein or known in the art.

In one embodiment, the pharmaceutical composition further comprises a solvent.

In one embodiment, the solvent comprises water.

In one embodiment, the solvent comprises a pharmaceutically acceptable organic solvent. Any useful and pharmaceutically acceptable organic solvents can be used in the compositions of the invention.

In one embodiment, the pharmaceutical composition is a solution of the salt in the pharmaceutically acceptable organic solvent.

In one embodiment, the pharmaceutical composition comprises a pharmaceutically acceptable organic solvent and further comprises a phospholipid, a sphingomyelin, or phosphatidyl choline. Without wishing to be bound by theory, it is believed that the phospholipid, sphingomyelin, or phosphatidyl choline facilitates formation of a precipitate when the pharmaceutical composition is injected into water and can also facilitate controlled release of the multipartite construct from the resulting precipitate. Typically, the phospholipid, sphingomyelin, or phosphatidyl choline is present in an amount ranging from greater than 0 to 10 percent by weight of the pharmaceutical composition. In one embodiment, the phospholipid, sphingomyelin, or phosphatidyl choline is present in an amount ranging from about 0.1 to 10 percent by weight of the pharmaceutical composition. In one embodiment, the phospholipid, sphingomyelin, or phosphatidyl choline is present in an amount ranging from about 1 to 7.5 percent by weight of the pharmaceutical composition. In one embodiment, the phospholipid, sphingomyelin, or phosphatidyl choline is present in an amount ranging from about 1.5 to 5 percent by weight of the pharmaceutical composition. In one embodiment, the phospholipid, sphingomyelin, or phosphatidyl choline is present in an amount ranging from about 2 to 4 percent by weight of the pharmaceutical composition.

The pharmaceutical compositions can optionally comprise one or more additional excipients or additives to provide a dosage form suitable for administration to an animal. When administered to an animal, the multipartite construct containing pharmaceutical compositions are typically administered as a component of a composition that comprises a pharmaceutically acceptable carrier or excipient so as to provide the form for proper administration to the animal. Suitable pharmaceutical excipients are described in Remington's Pharmaceutical Sciences 1447-1676 (Alfonso R. Gennaro ed., 19th ed. 1995), incorporated herein by reference. The pharmaceutical compositions can take the form of solutions, suspensions, emulsion, tablets, pills, pellets, capsules, capsules containing liquids, powders, suppositories, emulsions, aerosols, sprays, suspensions, or any other form suitable for use.

In one embodiment, the pharmaceutical compositions are formulated for intravenous or parenteral administration. Typically, compositions for intravenous or parenteral administration comprise a suitable sterile solvent, which may be an isotonic aqueous buffer or pharmaceutically acceptable organic solvent. Where necessary, the compositions can also include a solubilizing agent. Compositions for intravenous administration can optionally include a local anesthetic such as lidocaine to lessen pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where multipartite construct containing pharmaceutical compositions are to be administered by infusion, they can be dispensed, for example, with an infusion bottle containing, for example, sterile pharmaceutical grade water or saline. Where the pharmaceutical compositions are administered by injection, an ampoule of sterile water for injection, saline, or other solvent such as a pharmaceutically acceptable organic solvent can be provided so that the ingredients can be mixed prior to administration.

In another embodiment, the pharmaceutical compositions are formulated in accordance with routine procedures as a composition adapted for oral administration. Compositions for oral delivery can be in the form of tablets, lozenges, aqueous or oily suspensions, granules, powders, emulsions, capsules, syrups, or elixirs, for example. Oral compositions can include standard excipients such as mannitol, lactose, starch, magnesium stearate, sodium saccharin, cellulose, and magnesium carbonate. Typically, the excipients are of pharmaceutical grade. Orally administered compositions can also contain one or more agents, for example, sweetening agents such as fructose, aspartame or saccharin; flavoring agents such as peppermint, oil of wintergreen, or cherry; coloring agents; and preserving agents, to provide a pharmaceutically palatable preparation. Moreover, when in tablet or pill form, the compositions can be coated to delay disintegration and absorption in the gastrointestinal tract thereby providing a sustained action over an extended period of time. Selectively permeable membranes surrounding an osmotically active driving compound are also suitable for orally administered compositions. A time-delay material such as glycerol monostearate or glycerol stearate can also be used.

The pharmaceutical compositions further comprising a solvent can optionally comprise a suitable amount of a pharmaceutically acceptable preservative, if desired, so as to provide additional protection against microbial growth. Examples of preservatives useful in the pharmaceutical compositions of the invention include, but are not limited to, potassium sorbate, methylparaben, propylparaben, benzoic acid and its salts, other esters of parahydroxybenzoic acid such as butylparaben, alcohols such as ethyl or benzyl alcohol, phenolic compounds such as phenol, or quaternary compounds such as benzalkonium chlorides (e.g., benzethonium chloride).

In one embodiment, the pharmaceutical compositions of the invention optionally contain a suitable amount of a pharmaceutically acceptable polymer. The polymer can increase the viscosity of the pharmaceutical composition. Suitable polymers for use in the compositions and methods of the invention include, but are not limited to, hydroxypropylcellulose, hydoxypropylmethylcellulose (HPMC), chitosan, polyacrylic acid, and polymethacrylic acid.

Typically, the polymer is present in an amount ranging from greater than 0 to 10 percent by weight of the pharmaceutical composition. In one embodiment, the polymer is present in an amount ranging from about 0.1 to 10 percent by weight of the pharmaceutical composition. In one embodiment, the polymer is present in an amount ranging from about 1 to 7.5 percent by weight of the pharmaceutical composition. In one embodiment, the polymer is present in an amount ranging from about 1.5 to 5 percent by weight of the pharmaceutical composition. In one embodiment, the polymer is present in an amount ranging from about 2 to 4 percent by weight of the pharmaceutical composition. In one embodiment, the pharmaceutical compositions of the invention are substantially free of polymers.

In one embodiment, any additional components added to the pharmaceutical compositions of the invention are designated as GRAS by the FDA for use or consumption by animals. In one embodiment, any additional components added to the pharmaceutical compositions of the invention are designated as GRAS by the FDA for use or consumption by humans.

The components of the pharmaceutical composition (the solvents and any other optional components) are preferably biocompatible and non-toxic and, over time, are simply absorbed and/or metabolized by the body.

As described above, the pharmaceutical compositions of the invention can further comprise a solvent.

In one embodiment, the solvent comprises water.

In one embodiment, the solvent comprises a pharmaceutically acceptable organic solvent.

In an embodiment, the multipartite constructs are available as the salt of a metal cation, for example, as the potassium or sodium salt. These salts, however, may have low solubility in aqueous solvents and/or organic solvents, typically, less than about 25 mg/mL. The pharmaceutical compositions of the invention comprising (i) an amino acid ester or amino acid amide and (ii) a protonated multipartite construct, however, may be significantly more soluble in aqueous solvents and/or organic solvents. Without wishing to be bound by theory, it is believed that the amino acid ester or amino acid amide and the protonated multipartite construct form a salt, such as illustrated above, and the salt is soluble in aqueous and/or organic solvents.

Similarly, without wishing to be bound by theory, it is believed that the pharmaceutical compositions comprising (i) a multipartite construct; (ii) a divalent metal cation; and (iii) optionally a carboxylate, a phospholipid, a phosphatidyl choline, or a sphingomyelin form a salt, such as illustrated above, and the salt is soluble in aqueous and/or organic solvents.

In one embodiment, the concentration of the multipartite construct in the solvent is greater than about 2 percent by weight of the pharmaceutical composition. In one embodiment, the concentration of the multipartite construct in the solvent is greater than about 5 percent by weight of the pharmaceutical composition. In one embodiment, the concentration of the multipartite construct in the solvent is greater than about 7.5 percent by weight of the pharmaceutical composition. In one embodiment, the concentration of the multipartite construct in the solvent is greater than about 10 percent by weight of the pharmaceutical composition. In one embodiment, the concentration of the multipartite construct in the solvent is greater than about 12 percent by weight of the pharmaceutical composition. In one embodiment, the concentration of the multipartite construct in the solvent is greater than about 15 percent by weight of the pharmaceutical composition. In one embodiment, the concentration of the multipartite construct in the solvent is ranges from about 2 percent to 5 percent by weight of the pharmaceutical composition. In one embodiment, the concentration of the multipartite construct in the solvent is ranges from about 2 percent to 7.5 percent by weight of the pharmaceutical composition. In one embodiment, the concentration of the multipartite construct in the solvent ranges from about 2 percent to 10 percent by weight of the pharmaceutical composition. In one embodiment, the concentration of the multipartite construct in the solvent is ranges from about 2 percent to 12 percent by weight of the pharmaceutical composition. In one embodiment, the concentration of the multipartite construct in the solvent is ranges from about 2 percent to 15 percent by weight of the pharmaceutical composition. In one embodiment, the concentration of the multipartite construct in the solvent is ranges from about 2 percent to 20 percent by weight of the pharmaceutical composition.

Any pharmaceutically acceptable organic solvent can be used in the pharmaceutical compositions of the invention. Representative, pharmaceutically acceptable organic solvents include, but are not limited to, pyrrolidone, N-methyl-2-pyrrolidone, polyethylene glycol, propylene glycol (i.e., 1,3-propylene glycol), glycerol formal, isosorbid dimethyl ether, ethanol, dimethyl sulfoxide, tetraglycol, tetrahydrofurfuryl alcohol, triacetin, propylene carbonate, dimethyl acetamide, dimethyl formamide, dimethyl sulfoxide, and combinations thereof.

In one embodiment, the pharmaceutically acceptable organic solvent is a water soluble solvent. A representative pharmaceutically acceptable water soluble organic solvents is triacetin.

In one embodiment, the pharmaceutically acceptable organic solvent is a water miscible solvent. Representative pharmaceutically acceptable water miscible organic solvents include, but are not limited to, glycerol formal, polyethylene glycol, and propylene glycol.

In one embodiment, the pharmaceutically acceptable organic solvent comprises pyrrolidone. In one embodiment, the pharmaceutically acceptable organic solvent is pyrrolidone substantially free of another organic solvent.

In one embodiment, the pharmaceutically acceptable organic solvent comprises N-methyl-2-pyrrolidone. In one embodiment, the pharmaceutically acceptable organic solvent is N-methyl-2-pyrrolidone substantially free of another organic solvent.

In one embodiment, the pharmaceutically acceptable organic solvent comprises polyethylene glycol. In one embodiment, the pharmaceutically acceptable organic solvent is polyethylene glycol substantially free of another organic solvent.

In one embodiment, the pharmaceutically acceptable organic solvent comprises propylene glycol. In one embodiment, the pharmaceutically acceptable organic solvent is propylene glycol substantially free of another organic solvent.

In one embodiment, the pharmaceutically acceptable organic solvent comprises glycerol formal. In one embodiment, the pharmaceutically acceptable organic solvent is glycerol formal substantially free of another organic solvent.

In one embodiment, the pharmaceutically acceptable organic solvent comprises isosorbid dimethyl ether. In one embodiment, the pharmaceutically acceptable organic solvent is isosorbid dimethyl ether substantially free of another organic solvent.

In one embodiment, the pharmaceutically acceptable organic solvent comprises ethanol. In one embodiment, the pharmaceutically acceptable organic solvent is ethanol substantially free of another organic solvent.

In one embodiment, the pharmaceutically acceptable organic solvent comprises dimethyl sulfoxide. In one embodiment, the pharmaceutically acceptable organic solvent is dimethyl sulfoxide substantially free of another organic solvent.

In one embodiment, the pharmaceutically acceptable organic solvent comprises tetraglycol. In one embodiment, the pharmaceutically acceptable organic solvent is tetraglycol substantially free of another organic solvent.

In one embodiment, the pharmaceutically acceptable organic solvent comprises tetrahydrofurfuryl alcohol. In one embodiment, the pharmaceutically acceptable organic solvent is tetrahydrofurfuryl alcohol substantially free of another organic solvent.

In one embodiment, the pharmaceutically acceptable organic solvent comprises triacetin. In one embodiment, the pharmaceutically acceptable organic solvent is triacetin substantially free of another organic solvent.

In one embodiment, the pharmaceutically acceptable organic solvent comprises propylene carbonate. In one embodiment, the pharmaceutically acceptable organic solvent is propylene carbonate substantially free of another organic solvent.

In one embodiment, the pharmaceutically acceptable organic solvent comprises dimethyl acetamide. In one embodiment, the pharmaceutically acceptable organic solvent is dimethyl acetamide substantially free of another organic solvent.

In one embodiment, the pharmaceutically acceptable organic solvent comprises dimethyl formamide. In one embodiment, the pharmaceutically acceptable organic solvent is dimethyl formamide substantially free of another organic solvent.

In one embodiment, the pharmaceutically acceptable organic solvent comprises at least two pharmaceutically acceptable organic solvents.

In one embodiment, the pharmaceutically acceptable organic solvent comprises N-methyl-2-pyrrolidone and glycerol formal. In one embodiment, the pharmaceutically acceptable organic solvent is N-methyl-2-pyrrolidone and glycerol formal. In one embodiment, the ratio of N-methyl-2-pyrrolidone to glycerol formal ranges from about 90:10 to 10:90.

In one embodiment, the pharmaceutically acceptable organic solvent comprises propylene glycol and glycerol formal. In one embodiment, the pharmaceutically acceptable organic solvent is propylene glycol and glycerol formal. In one embodiment, the ratio of propylene glycol to glycerol formal ranges from about 90:10 to 10:90.

In one embodiment, the pharmaceutically acceptable organic solvent is a solvent that is recognized as GRAS by the FDA for administration or consumption by animals. In one embodiment, the pharmaceutically acceptable organic solvent is a solvent that is recognized as GRAS by the FDA for administration or consumption by humans.

In one embodiment, the pharmaceutically acceptable organic solvent is substantially free of water. In one embodiment, the pharmaceutically acceptable organic solvent contains less than about 1 percent by weight of water. In one embodiment, the pharmaceutically acceptable organic solvent contains less about 0.5 percent by weight of water. In one embodiment, the pharmaceutically acceptable organic solvent contains less about 0.2 percent by weight of water. Pharmaceutically acceptable organic solvents that are substantially free of water are advantageous since they are not conducive to bacterial growth. Accordingly, it is typically not necessary to include a preservative in pharmaceutical compositions that are substantially free of water. Another advantage of pharmaceutical compositions that use a pharmaceutically acceptable organic solvent, preferably substantially free of water, as the solvent is that hydrolysis of the multipartite construct is minimized. Typically, the more water present in the solvent the more readily the multipartite construct can be hydrolyzed. Accordingly, multipartite construct containing pharmaceutical compositions that use a pharmaceutically acceptable organic solvent as the solvent can be more stable tha multipartite construct containing pharmaceutical compositions that use water as the solvent.

In one embodiment, comprising a pharmaceutically acceptable organic solvent, the pharmaceutical composition is injectable.

In one embodiment, the injectable pharmaceutical compositions are of sufficiently low viscosity that they can be easily drawn into a 20 gauge and needle and then easily expelled from the 20 gauge needle. Typically, the viscosity of the injectable pharmaceutical compositions are less than about 1,200 cps. In one embodiment, the viscosity of the injectable pharmaceutical compositions are less than about 1,000 cps. In one embodiment, the viscosity of the injectable pharmaceutical compositions are less than about 800 cps. In one embodiment, the viscosity of the injectable pharmaceutical compositions are less than about 500 cps. Injectable pharmaceutical compositions having a viscosity greater than about 1,200 cps and even greater than about 2,000 cps (for example gels) are also within the scope of the invention provided that the compositions can be expelled through an 18 to 24 gauge needle.

In one embodiment, comprising a pharmaceutically acceptable organic solvent, the pharmaceutical composition is injectable and does not form a precipitate when injected into water.

In one embodiment, comprising a pharmaceutically acceptable organic solvent, the pharmaceutical composition is injectable and forms a precipitate when injected into water. Without wishing to be bound by theory, it is believed, for pharmaceutical compositions that comprise a protonated multipartite construct and an amino acid ester or amide, that the $\alpha$-amino group of the amino acid ester or amino acid amide is protonated by the multipartite construct to form a salt, such as illustrated above, which is soluble in the pharmaceutically acceptable organic solvent but insoluble in water. Similarly, when the pharmaceutical composition comprises (i) a multipartite construct; (ii) a divalent metal cation; and (iii) optionally a carboxylate, a phospholipid, a phosphatidyl choline, or a sphingomyelin, it is believed that the components of the composition form a salt, such as illustrated above, which is soluble in the pharmaceutically acceptable organic solvent but insoluble in water. Accordingly, when the pharmaceutical compositions are injected into an animal, at least a portion of the pharmaceutical composition precipitates at the injection site to provide a drug depot. Without wishing to be bound by theory, it is believed that when the pharmaceutically compositions are injected into an animal, the pharmaceutically acceptable organic solvent diffuses away from the injection site and aqueous bodily fluids diffuse towards the injection site, resulting in an increase in concentration of water at the injection site, that causes at least a portion of the composition to precipitate and form a drug depot. The precipitate can take the form of a solid, a crystal, a gummy mass, or a gel. The precipitate, however, provides a depot of the multipartite construct at the injection site that releases the multipartite construct over time. The components of the pharmaceutical composition, i.e., the amino acid ester or amino acid amide, the pharmaceutically acceptable organic solvent, and any other components are biocompatible and non-toxic and, over time, are simply absorbed and/or metabolized by the body.

In one embodiment, comprising a pharmaceutically acceptable organic solvent, the pharmaceutical composition is injectable and forms liposomal or micellar structures when injected into water (typically about 500 µL are injected into about 4 mL of water). The formation of liposomal or micellar structures are most often formed when the pharmaceutical composition includes a phospholipid. Without wishing to be bound by theory, it is believed that the multipartite construct in the form of a salt, which can be a salt formed with an amino acid ester or amide or can be a salt with a divalent metal cation and optionally a carboxylate, a phospholipid, a phosphatidyl choline, or a sphingomyelin, that is trapped within the liposomal or micellar structure. Without wishing to be bound by theory, it is believed that when these pharmaceutically compositions are injected into an animal, the liposomal or micellar structures release the multipartite construct over time.

In one embodiment, the pharmaceutical composition further comprising a pharmaceutically acceptable organic solvent is a suspension of solid particles in the pharmaceutically acceptable organic solvent. Without wishing to be bound by theory, it is believed that the solid particles comprise a salt formed between the amino acid ester or amino acid amide and the protonated multipartite construct wherein the acidic phosphate groups of the multipartite construct protonates the amino group of the amino acid ester or amino acid amide, such as illustrated above, or comprises a salt formed between the multipartite construct; divalent metal cation; and optional carboxylate, phospholipid, phosphatidyl choline, or sphingomyelin, as illustrated above. Pharmaceutical compositions that are suspensions can also form drug depots when injected into an animal.

By varying the lipophilicity and/or molecular weight of the amino acid ester or amino acid amide it is possible to vary the properties of pharmaceutical compositions that include these components and further comprise an organic solvent. The lipophilicity and/or molecular weight of the amino acid ester or amino acid amide can be varied by varying the amino acid and/or the alcohol (or amine) used to form the amino acid ester (or amino acid amide). For example, the lipophilicity and/or molecular weight of the amino acid ester can be varied by varying the R1 hydrocarbon group of the amino acid ester. Typically, increasing the molecular weight of R1 increase the lipophilicity of the amino acid ester. Similarly, the lipophilicity and/or molecular weight of the amino acid amide can be varied by varying the R3 or R4 groups of the amino acid amide.

For example, by varying the lipophilicity and/or molecular weight of the amino acid ester or amino acid amide it is possible to vary the solubility of the multipartite construct in water, to vary the solubility of the multipartite construct in the organic solvent, vary the viscosity of the pharmaceutical composition comprising a solvent, and vary the ease at which the pharmaceutical composition can be drawn into a 20 gauge needle and then expelled from the 20 gauge needle.

Furthermore, by varying the lipophilicity and/or molecular weight of the amino acid ester or amino acid amide (i.e., by varying R1 of the amino acid ester or R3 and R4 of the amino acid amide) it is possible to control whether the pharmaceutical composition that further comprises an organic solvent will form a precipitate when injected into water. Although different multipartite constructs exhibit different solubility and behavior, generally the higher the molecular weight of the amino acid ester or amino acid amide, the more likely it is that the salt of the protonated multipartite construct and the amino acid ester of the amide will form a precipitate when injected into water. Typically, when R1 of the amino acid ester is a hydrocarbon of about C16 or higher the pharmaceutical composition will form a precipitate when injected into water and when R1 of the amino acid ester is a hydrocarbon of about C12 or less the pharmaceutical composition will not form a precipitate when injected into water. Indeed, with amino acid esters wherein R1 is a hydrocarbon of about C12 or less, the salt of the protonated multipartite construct and the amino acid ester is, in many cases, soluble in water. Similarly, with amino acid amides, if the combined number of carbons in R3 and R4 is 16 or more the pharmaceutical composition will typically form a precipitate when injected into water and if the combined number of carbons in R3 and R4 is 12 or less the pharmaceutical composition will not form a precipitate when injected into water. Whether or not a pharmaceutical composition that further comprises a pharmaceutically acceptable organic solvent will form a precipitate when injected into water can readily be determined by injecting about 0.05 mL of the pharmaceutical composition into about 4 mL of water at about 98° F. and determining how much material is retained on a 0.22 μm filter after the composition is mixed with water and filtered. Typically, a formulation or composition is considered to be injectable when no more than 10% of the formulation is retained on the filter. In one embodiment, no more than 5% of the formulation is retained on the filter. In one embodiment, no more than 2% of the formulation is retained on the filter. In one embodiment, no more than 1% of the formulation is retained on the filter.

Similarly, in pharmaceutical compositions that comprise a protonated multipartite construct and a diester or diamide of aspartic or glutamic acid, it is possible to vary the properties of pharmaceutical compositions by varying the amount and/or lipophilicity and/or molecular weight of the diester or diamide of aspartic or glutamic acid. Similarly, in pharmaceutical compositions that comprise a multipartite construct; a divalent metal cation; and a carboxylate, a phospholipid, a phosphatidyl choline, or a sphingomyelin, it is possible to vary the properties of pharmaceutical compositions by varying the amount and/or lipophilicity and/or molecular weight of the carboxylate, phospholipid, phosphatidyl choline, or sphingomyelin.

Further, when the pharmaceutical compositions that further comprises an organic solvent form a depot when administered to an animal, it is also possible to vary the rate at which the multipartite construct is released from the drug depot by varying the lipophilicity and/or molecular weight of the amino acid ester or amino acid amide. Generally, the more lipophilic the amino acid ester or amino acid amide, the more slowly the multipartite construct is released from the depot. Similarly, when the pharmaceutical compositions that further comprises an organic solvent and also further comprise a carboxylate, phospholipid, phosphatidyl choline, sphingomyelin, or a diester or diamide of aspartic or glutamic acid and form a depot when administered to an animal, it is possible to vary the rate at which the multipartite construct is released from the drug depot by varying the amount and/or lipophilicity and/or molecular weight of the carboxylate, phospholipid, phosphatidyl choline, sphingomyelin, or the diester or diamide of aspartic or glutamic acid.

Release rates from a precipitate can be measured injecting about 50 μL of the pharmaceutical composition into about 4 mL of deionized water in a centrifuge tube. The time that the pharmaceutical composition is injected into the water is recorded as T=0. After a specified amount of time, T, the sample is cooled to about −9° C. and spun on a centrifuge at about 13,000 rpm for about 20 min. The resulting supernatant is then analyzed by HPLC to determine the amount of multipartite construct present in the aqueous solution. The amount of multipartite construct in the pellet resulting from the centrifugation can also be determined by collecting the pellet, dissolving the pellet in about 10 μL of methanol, and analyzing the methanol solution by HPLC to determine the amount of multipartite construct in the precipitate. The amount of multipartite construct in the aqueous solution and the amount of multipartite construct in the precipitate are determined by comparing the peak area for the HPLC peak corresponding to the multipartite construct against a standard curve of multipartite construct peak area against concentration of multipartite construct. Suitable HPLC conditions can be readily determined by one of ordinary skill in the art.

Methods of Treatment

The pharmaceutical compositions of the invention are useful in human medicine and veterinary medicine. Accordingly, the invention further relates to a method of treating or preventing a condition in an animal comprising administering to the animal an effective amount of the pharmaceutical composition of the invention.

In one embodiment, the invention relates to methods of treating a condition in an animal comprising administering to an animal in need thereof an effective amount of a pharmaceutical composition of the invention.

In one embodiment, the invention relates to methods of preventing a condition in an animal comprising administering to an animal in need thereof an effective amount of a pharmaceutical composition of the invention.

Methods of administration include, but are not limited to, intradermal, intramuscular, intraperitoneal, intravenous, subcutaneous, intranasal, epidural, oral, sublingual, intracerebral, intravaginal, transdermal, rectal, by inhalation, or topical. The mode of administration is left to the discretion of the practitioner. In some embodiments, administration will result in the release of the multipartite construct into the bloodstream.

In one embodiment, the method of treating or preventing a condition in an animal comprises administering to the animal in need thereof an effective amount of a multipartite construct by parenterally administering the pharmaceutical composition of the invention. In one embodiment, the pharmaceutical compositions are administered by infusion or bolus injection. In one embodiment, the pharmaceutical composition is administered subcutaneously.

In one embodiment, the method of treating or preventing a condition in an animal comprises administering to the animal in need thereof an effective amount of a multipartite construct by orally administering the pharmaceutical composition of the invention. In one embodiment, the composition is in the form of a capsule or tablet.

The pharmaceutical compositions can also be administered by any other convenient route, for example, topically, by absorption through epithelial or mucocutaneous linings (e.g., oral, rectal, and intestinal mucosa, etc.).

The pharmaceutical compositions can be administered systemically or locally.

The pharmaceutical compositions can be administered together with another biologically active agent.

In one embodiment, the animal is a mammal.

In one embodiment the animal is a human.

In one embodiment, the animal is a non-human animal.

In one embodiment, the animal is a canine, a feline, an equine, a bovine, an ovine, or a porcine.

The effective amount administered to the animal depends on a variety of factors including, but not limited to the type of animal being treated, the condition being treated, the severity of the condition, and the specific multipartite construct being administered. A treating physician can determine an effective amount of the pharmaceutical composition to treat a condition in an animal.

In one embodiment, the multipartite construct comprises an anti-EpCAM aptamer segment. For example, the target of interest comprises EpCAM. In another embodiment, the target is selected from the group of proteins consisting of a EGFR, PBP, EpCAM, and KLK2. In another embodiment, the target is selected from the group of proteins consisting of a tetraspanin, EpCam, CD9, PCSA, CD63, CD81, PSMA, B7H3, PSCA, ICAM, STEAP, KLK2, SSx2, SSx4, PBP, SPDEF, and EGFR. In another embodiment, the target is selected from the group of proteins consisting of CD9, PSMA, PCSA, CD63, CD81, B7H3, IL 6, OPG-13, IL6R, PA2G4, EZH2, RUNX2, SERPINB3, and EpCam. In another embodiment, a target is selected from the group of proteins consisting of A33, a33 n15, AFP, ALA, ALIX, ALP, AnnexinV, APC, ASCA, ASPH (246-260), ASPH (666-680), ASPH (A-10), ASPH (D01P), ASPH (D03), ASPH (G-20), ASPH (H-300), AURKA, AURKB, B7H3, B7H4, BCA-225, BCNP1, BDNF, BRCA, CA125 (MUC16), CA-19-9, C-Bir, CD1.1, CD10, CD174 (Lewis y), CD24, CD44, CD46, CD59 (MEM-43), CD63, CD66e CEA, CD73, CD81, CD9, CDA, CDAC1 1a2, CEA, C-Erb2, C-erbB2, CRMP-2, CRP, CXCL12, CYFRA21-1, DLL4, DR3, EGFR, Epcam, EphA2, EphA2 (H-77), ER, ErbB4, EZH2, FASL, FRT, FRT c.f23, GDF15, GPCR, GPR30, Gro-alpha, HAP, HBD 1, HBD2, HER 3 (ErbB3), HSP, HSP70, hVEGFR2, iC3b, IL 6 Unc, IL-1B, IL6 Unc, IL6R, IL8, IL-8, INSIG-2, KLK2, L1CAM, LAMN, LDH, MACC-1, MAPK4, MART-1, MCP-1, M-CSF, MFG-E8, MIC1, MIF, MIS RII, MMG, MMP26, MMP7, MMP9, MS4A1, MUC1, MUC1 seq1, MUC1 seq11A, MUC17, MUC2, Ncam, NGAL, NPGP/NPFF2, OPG, OPN, p53, p53, PA2G4, PBP, PCSA, PDGFRB, PGP9.5, PIM1, PR (B), PRL, PSA, PSMA, PSME3, PTEN, R5-CD9 Tube 1, Reg IV, RUNX2, SCRN1, seprase, SERPINB3, SPARC, SPB, SPDEF, SRVN, STAT 3, STEAP1, TF (FL-295), TFF3, TGM2, TIMP-1, TIMP1, TIMP2, TMEM211, TMPRSS2, TNF-alpha, Trail-R2, Trail-R4, TrKB, TROP2, Tsg 101, TWEAK, UNC93A, VEGF A, and YPSMA-1. In another embodiment, the target is selected from the group of proteins consisting of 5T4, ACTG1, ADAM10, ADAM15, ALDOA, ANXA2, ANXA6, APOA1, ATP1A1, BASP1, C1orf58, C20orf114, C8B, CAPZA1, CAV1, CD151, CD2AP, CD59, CD9, CD9, CFL1, CFP, CHMP4B, CLTC, COTL1, CTNND1, CTSB, CTSZ, CYCS, DPP4, EEF1A1, EHD1, ENO1, F11R, F2, F5, FAM125A, FNBP1L, FOLH1, GAPDH, GLB1, GPX3, HIST1H1C, HIST1H2AB, HSP90AB1, HSPA1B, HSPA8, IGSF8, ITGB1, ITIH3, JUP, LDHA, LDHB, LUM, LYZ, MFGE8, MGAM, MMP9, MYH2, MYL6B, NME1, NME2, PABPC1, PABPC4, PACSIN2, PCBP2, PDCD6IP, PRDX2, PSA, PSMA, PSMA1, PSMA2, PSMA4, PSMA6, PSMA7, PSMB1, PSMB2, PSMB3, PSMB4, PSMB5, PSMB6, PSMB8, PTGFRN, RPS27A, SDCBP, SERINC5, SH3GL1, SLC3A2, SMPDL3B, SNX9, TACSTD1, TCN2, THBS1, TPI1, TSG101, TUBB, VDAC2, VPS37B, YWHAG, YWHAQ, and YWHAZ. In another embodiment, the target is selected from the group of proteins consisting of CD9, CD63, CD81, PSMA, PCSA, B7H3 and EpCam. CD9, CD63, CD81, PSMA, PCSA, B7H3 and EpCam. In another embodiment, the target is selected from the group of proteins consisting of a tetraspanin, CD9, CD63, CD81, CD63, CD9, CD81, CD82, CD37, CD53, Rab-5b, Annexin V, MFG-E8, Muc1, GPCR 110, TMEM211 and CD24 In another embodiment, the target is selected from the group of proteins consisting of A33, AFP, ALIX, ALX4, ANCA, APC, ASCA, AURKA, AURKB, B7H3, BANK1, BCNP1, BDNF, CA-19-9, CCSA-2, CCSA-3&4, CD10, CD24, CD44, CD63, CD66 CEA, CD66e CEA, CD81, CD9, CDA, C-Erb2, CRMP-2, CRP, CRTN, CXCL12, CYFRA21-1, DcR3, DLL4, DR3, EGFR, Epcam, EphA2, FASL, FRT, GAL3, GDF15, GPCR (GPR110), GPR30, GRO-1, HBD 1, HBD2, HNP1-3, IL-1B, IL8, IMP3, L1CAM, LAMN, MACC-1, MGC20553, MCP-1, M-CSF, MIC1, MIF, MMP7, MMP9, MS4A1, MUC1, MUC17, MUC2, Ncam, NGAL, NNMT, OPN, p53, PCSA, PDGFRB, PRL, PSMA, PSME3, Reg IV, SCRN1, Sept-9, SPARC, SPON2, SPR, SRVN, TFF3, TGM2, TIMP-1, TMEM211, TNF-alpha, TPA, TPS, Trail-R2, Trail-R4, TrKB, TROP2, Tsg 101, TWEAK, UNC93A, and VEGFA. In another embodiment, the target is selected from the group of proteins consisting of CD9, EGFR, NGAL, CD81, STEAP, CD24, A33, CD66E, EPHA2, Ferritin, GPR30, GPR110, MMP9, OPN, p53, TMEM211, TROP2, TGM2, TIMP, EGFR, DR3, UNC93A, MUC17, EpCAM, MUC1, MUC2, TSG101, CD63, B7H3, CD24, and a tetraspanin.

The immunosuppressive target can be a tumor-derived protein found on cMVs and/or cancer cells, including without limitation TGF-β, CD39, CD73, IL10, FasL or TRAIL.

In one embodiment, the multipartite construct can inhibit angiogenesis. In one embodiment, the multipartite construct can inhibit angiogenesis and the disease being treated is cancer. In one embodiment, the aptamer can inhibit angiogenesis and the disease being treated is a solid tumor. The multipartite construct can be a multipartite construct that inhibits a neoplastic growth or a cancer. In embodiments, the cancer comprises an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sézary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenström macroglobulinemia; or Wilm's tumor. The compositions and methods of the invention can be used to treat these and other cancers.

Kits

The invention also provides a kit comprising one or more reagent to carry out the methods of the invention. For example, the one or more reagent can be the one or more aptamer, a buffer, blocker, enzyme, or combination thereof. The one or more reagent may comprise any useful reagents for carrying out the subject methods, including without limitation aptamer libraries, substrates such as microbeads or planar arrays or wells, reagents for biomarker and/or microvesicle isolation (e.g., via chromatography, filtration, ultrafiltration, centrifugation, ultracentrifugation, flow cytometry, affinity capture (e.g., to a planar surface, column or bead), polymer precipitation, and/or using microfluidics), aptamers directed to specific targets, aptamer pools that facilitate detection of a biomarker/microvesicle population, reagents such as primers for nucleic acid sequencing or amplification, arrays for nucleic acid hybridization, detectable labels, solvents or buffers and the like, various linkers, various assay components, blockers, and the like. The one or more reagent may also comprise various compositions provided by the invention. In an embodiment, the one or more reagent comprises one or more aptamer of the invention. The one or more reagent can comprise a substrate, such as a planar substrate, column or bead. The kit can contain instructions to carry out various assays using the one or more reagent.

In an embodiment, the kit comprises an oligonucleotide probe or composition provided herein. The kit can be configured to carry out the methods provided herein. For example, the kit can include an aptamer of the invention, a substrate, or both an aptamer of the invention and a substrate.

In an embodiment, the kit is configured to carry out an assay. For example, the kit can contain one or more reagent and instructions for detecting the presence or level of a biological entity in a biological sample. In such cases, the kit can include one or more binding agent to a biological entity of interest. The one or more binding agent can be bound to a substrate.

In an embodiment, the kit comprises a set of oligonucleotides that provide a particular oligonucleotide profile for a biological sample. An oligonucleotide profile can include, without limitation, a profile that can be used to characterize a particular disease or disorder. For example, the disease or disorder can be a proliferative disease or disorder, including without limitation a cancer. In some embodiments, the cancer comprises a breast cancer.

EXAMPLES

Example 1: Identification of DNA Oligonucleotides that Bind a Target

The target is affixed to a solid substrate, such as a glass slide or a magnetic bead. For a magnetic bead preparation, beads are incubated with a concentration of target protein ranging from 0.1 to 1 mg/ml. The target protein is conjugated to the beads according to a chemistry provided by the particular bead manufacturer. Typically, this involves coupling via an N-hydroxysuccinimide (NHS) functional group process. Unoccupied NHS groups are rendered inactive following conjugation with the target.

Randomly generated oligonucleotides (oligos) of a certain length, such as 32 base pairs long, are added to a container holding the stabilized target. Each oligo contains 6 thymine nucleotides (a "thymine tail") at either the 5 or 3 prime end, along with a single molecule of biotin conjugated to the thymine tail. Additional molecules of biotin could be added. Each oligo is also manufactured with a short stretch of nucleotides on each end (5-10 base pairs long) corresponding to amplification primers for PCR ("primer tails"). The sequences are shown absent the thymine tails or primer tails.

The oligonucleotides are incubated with the target at a specified temperature and time in phosphate-buffered saline (PBS) at 37 degrees Celsius in 500 microliter reaction volume.

The target/oligo combination is washed 1-10 times with buffer to remove unbound oligo. The number of washes increases with each repetition of the process (as noted below).

The oligos bound to the target are eluted using a buffer containing a chaotropic agent such as 7 M urea or 1% SDS and collected using the biotin tag. The oligos are amplified using the polymerase chain reaction using primers specific to 5' and 3' sequences added to the randomized region of the oligos. The amplified oligos are added to the target again for another round of selection. This process is repeated as desired to observe binding enrichment.

Example 2: Competitive Assay

The process is performed as in Example 1 above, except that a known ligand to the target, such as an antibody, is used to elute the bound oligo species (as opposed to or in addition to the chaotropic agent). In this case, anti-EpCAM antibody from Santa Cruz Biotechnology, Inc. was used to elute the aptamers from the target EpCAM.

Example 3: Screening and Affinity Analysis

All aptamers generated from the binding assays described above are sequenced using a high-throughput sequencing platform, such as the Ion Torrent from Life Technologies:

Library Preparation—Aptamers were pooled after ligating barcodes and adapter sequences (Life Technologies) according to manufacturer protocols. In brief, equimolar pools of the aptamers were made using the following steps: Analyzed an aliquot of each library with a Bioanalyzer™ instrument and Agilent DNA 1000 Kit or Agilent High Sensitivity Kit, as appropriate for the final library concentration. The molar concentration (nmol/L) of each amplicon library was determined using the commercially available software (Agilent).

An equimolar pool of the library was prepared at the highest possible concentration.

The combined concentration of the pooled library stock was calculated.

The template dilution factor of the library pool was determined using the following equation: Template Dilution Factor=(Library pool concentration [pM])/26 pM).

Template Preparation—Using a freshly diluted library, the aptamer pool resulting from binding assays provided above were sequenced using conventional sequencing protocols. High throughput (NextGen) sequencing methods can be used as desired.

Twenty aptamers were selected based on direct or competitive assays assessing binding to EpCAM (as described above).

Affinity Measurements—These twenty aptamers were then tested for binding affinity using an in vitro binding platform. SPR can be used for this step, e.g., a Biacore SPR machine using the T200 control software, as follows:

Dilute the antigen to a concentration of 32 nM.

Prepare necessary dilutions for kinetics, starting at 32 nM prepare two-fold dilutions of antigen down to 0.5 nM.

The Biacore 200 control software is programmed with the following conditions: Solution: HBS-EP+Buffer; Number of cycles: 3; Contact time: 120s; Flow rate: 30 µl/min; Dissociation time: 300s; Solution: Glycine-HCl pH 2.5; Contact time: 120s; Flow rate: 20 µl/min; Stabilization period: 0s. The binding affinities of these aptamers are then measured using the SPR assay above, or an alternate in vitro assay assessing the aptamer for a desired function.

Figure 5:
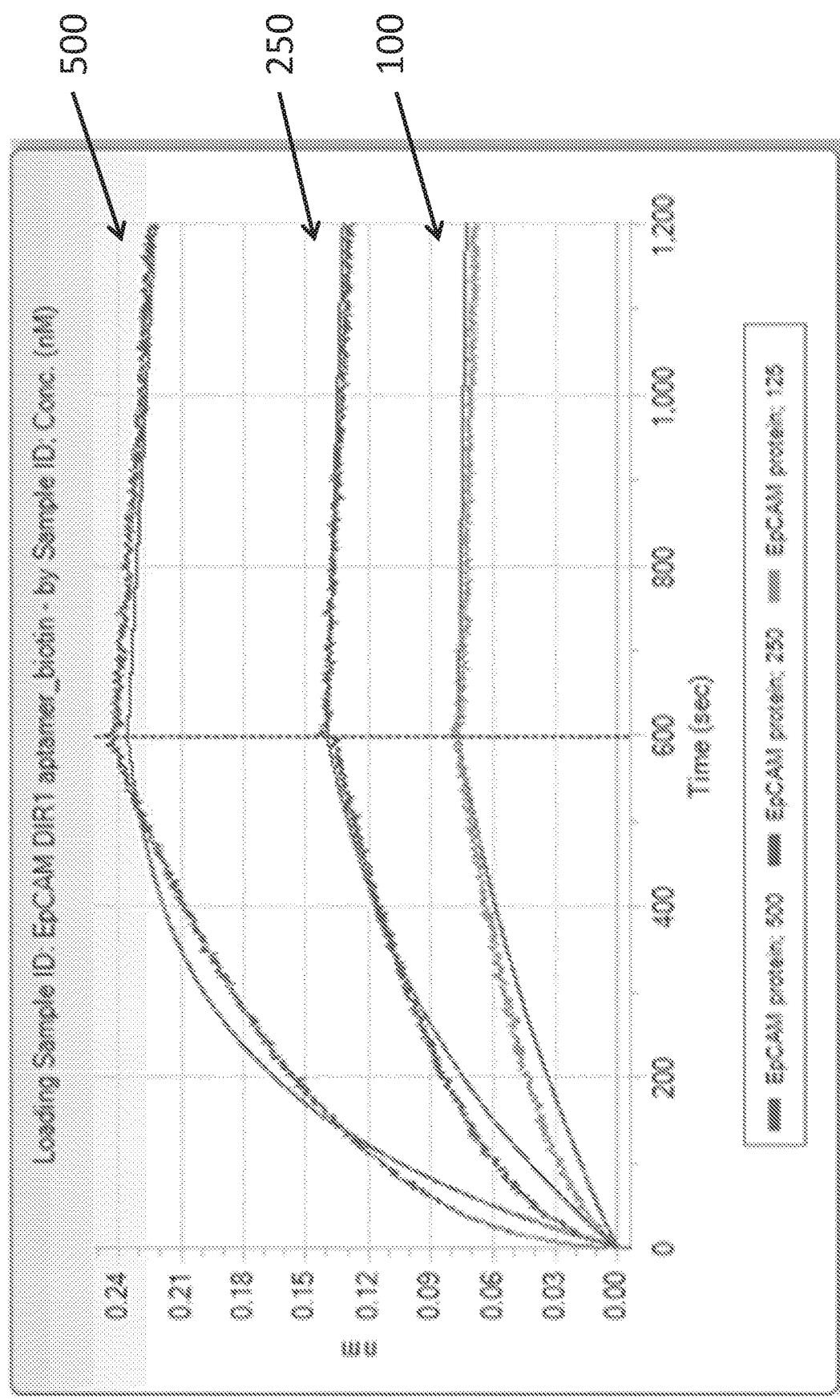
FIG. 5 illustrates results from a binding assay showing the binding affinity of an exemplary aptamer (Aptamer ID BTX176881 (SEQ ID NO: 3)) to the target EpCAM protein at various target concentrations. The aptamer to be tested is fixed to a substrate using a biotin tail and is incubated with various concentrations of target (125, 250 and 500 nM). The test is performed on a surface plasmon resonance machine (SPR). The SPR machine detects association and disassociation of the aptamer and the target. Target is applied until the association and disassociation events are equal, resulting in a plateau of the curve. The equations describing the curve at each concentration can then be used to calculate the $K_D$ of the aptamer (see Table 5).

FIG. 5 shows the SPR data for aptamer BTX176881 (SEQ ID NO: 3). The figure comprises an association and dissociation graph of 1:1 fitting model of the biotinylated aptamers to EpCAM protein at the indicated concentrations (nM). Table 5 shows the calculated $K_d$ values from the SPR measurements that are illustrated in FIG. 5. In addition, Table 5 shows the SPR data and calculated $K_d$ values for BTX187269 (SEQ ID NO: 6) and Aptamer 4 (SEQ ID NO. 1).

TABLE 5

Calculated $K_D$ values from SPR measurements

| Immobilized aptamer | Analyte | Conc (nM) | Response | $K_d$ (nM) | Full $R^2$ | Full $Chi^2$ |
|---|---|---|---|---|---|---|
| BTX176881 | EpCAM | 500 | 0.2434 | 8.40 | 0.989322 | 0.179008 |
| (SEQ ID No: | protein | 250 | 0.136 | 8.40 | 0.989322 | 0.179008 |
| 3) | | 100 | 0.0776 | 8.40 | 0.989322 | 0.179008 |
| BTX187269 | EpCAM | 500 | 0.2575 | 7.12 | 0.990323 | 0.215697 |
| (SEQ ID NO: | protein | 250 | 0.1584 | 7.12 | 0.990323 | 0.215697 |
| 6) | | 100 | 0.0551 | 7.12 | 0.990323 | 0.215697 |
| Aptamer 4 | EpCAM | 500 | 0.2742 | 10.10 | 0.986276 | 0.299279 |
| (SEQ ID NO. | protein | 250 | 0.1618 | 10.10 | 0.986276 | 0.299279 |
| 1) | | 100 | 0.0809 | 10.10 | 0.986276 | 0.299279 |

*$K_d$, $R^2$ and $Chi^2$ values by Global fitting for single reference method.

Example 4: Motif Analysis

The process of Example 3 is followed to identity a high affinity aptamer to a target of interest. Once a high affinity aptamer is identified, its sequence is then analyzed using a software program to estimate its two-dimensional folding structure. Well-known sequence alignment programs and algorithms for motif identification can be used to identify sequence motifs and reduce the dimensionality of even large data sets of sequences. Further, software programs such as Vienna and mfold are well-known to those skilled in the art of aptamer selection and can be used to further group sequences based on secondary structure motifs (shared shapes). See FIG. 3A and FIG. 3B for example structure predictions. Shared secondary structure of course, does not guarantee identical three-dimensional structure. Therefore "wet-lab" validation of aptamers is still useful as no one set of in silico tools has yet been able to fully predict the optimal aptamer among a set of aptamer candidates.

Example 5: Microvesicle-Based Aptamer Subtraction Assay

Circulating microvesicles are isolated from normal plasma (e.g., from individuals without cancer) using one of the following methods: 1) Isolation using the ExoQuick reagent according to manufacturer's protocol; 2) Ultracentrifugation comprising spin at 50,000 to 150,000 g for 1 to 20 hours then resuspending the pellet in PBS; 3) Isolation using the TEXIS reagent from Life Technologies according to manufacturer's protocol; and 4) filtration methodology. The filtration method is described in more detail as follows:

Place syringe and filter (1.2 µm Acrodisc Syringe Filter Versapor Membrane Non-Pyrogenic Ref: 4190, Pall Life Sciences) on open 7 ml 150K MWCO column (Pierce concentrators, 150K MWCO (molecular weight cut off) 7 ml. Part number: 89922). Fill open end of syringe with 5.2 ml of filtered 1× PBS prepared in sterile molecular grade water.

Pipette patient plasma (900-1000 µl) into the PBS in the syringe, pipette mix twice Filter the plasma into the 7 ml 150K MWCO column.

Centrifuge 7 ml 150K MWCO columns at 2000×g at 20° C. (16° C. to 24° C.) for 1 hour.

After 1 hour spin, pour the flow-through into 10% bleach to be discarded.

Visually inspect sample volume. If plasma concentrate is above the 8.5 ml graduation on the concentrator tube, continue to spin plasma sample at 10 minute increments at 2000×g at 20° C. (16° C. to 24° C.) checking volume after each spin until plasma concentrate is between 8.0 and 8.5 mls.

Pipette mix slowly on the column a minimum of 6 times and adjust pipette to determine plasma concentrate volume. If volume is between 100 µl and Target Volume, transfer plasma concentrate to previously labeled co-polymer 1.5 ml tube. If volume is still greater than Target Volume, repeat the above centrifugation step.

Pour ~45 mls of filtered 1×PBS prepared in sterile molecular grade water into 50 ml conical tube for use in the next step.

Add the appropriate amount of filtered 1×PBS to reconstitute the sample to the Target Volume.

The microvesicles produced using any of the isolation methods will comprise a mixture of vesicle types and will be various sizes with the possible exception of ultracentrifugation methods, which may favor isolating exosome size particles.

Randomly generated oligonucleotides (produced as described in Example 1 above) are incubated with the isolated normal vesicles in PBS overnight at room temperature or at 4 degrees Celsius.

The aptamers that do not bind to these vesicles are isolated by spinning down the vesicles at 50,000 to 150,000×g for 1 to 20 hours and collecting the supernatant.

The aptamer oligonucleotides are collected from the supernatant by running the mixture over a column containing streptavidin-coated beads. These aptamers are then added to vesicles isolated from diseased patients (using the same methods as above) and incubated overnight in PBS at room temperature or 4 degrees Celsius.

The vesicles are then spun at 50,000 to 150,000×g for 1 to 20 hours and the supernatant is discarded. The vesicles are resuspended in PBS and lysed using SDS or some similar detergent.

The aptamers are then captured by running the lysis mixture over a column of streptavidin-coated beads. The isolated aptamers are then subjected to a round of PCR to amplify the products.

The process is then repeated for a set number of times, e.g., 5 times. The remaining aptamer pool has been depleted of aptamers that recognize microvesicles found in "normal" plasma. Accordingly, this method can be used to enrich the pool in aptamers that recognize cancer vesicles. See FIG. 4.

Example 6: Detection of Microvesicles Using Anti-EpCAM Aptamers

Aptamers can be used as binding agents to detect a biomarker. In this Example, aptamers are used as binding agents to detect EpCAM protein associated with microvesicles.

FIGS. 6A-D illustrate the use of an anti-EpCAM aptamer (Aptamer 4; SEQ ID NO. 1) to detect a microvesicle population in plasma samples. Plasma samples were obtained from three men with prostate cancer and three men without prostate cancer (referred to as controls or normals). Antibodies to the following microvesicle surface protein antigens of interest were conjugated to microbeads (Luminex Corp, Austin, Tex.): FIG. 6A) EGFR (epidermal growth factor receptor); FIG. 6B) PBP (prostatic binding protein; also known as PEBP1 (phosphatidylethanolamine binding protein 1)); FIG. 6C) EpCAM (epithelial cell adhesion molecule); and FIG. 6D) KLK2 (kallikrein-related peptidase 2). Microvesicles in the plasma samples were captured using the bead-conjugated antibodies. Fluorescently labeled Aptamer 4 was used as a detector in the microbead assay. FIGS. 6A-D show the average median fluorescence values (MFI values) detected for the bead-captured and Aptamer 4 detected microvesicles. Each plot individually shows the three cancer (C1-C3) and three normal samples (N1-N3). These data show that, on average, the prostate cancer samples have higher levels of microvesicles containing the target proteins than the normals.

Example 7: Negative and Positive Selection of Aptamers

Aptamers can be used in various biological assays, including numerous types of assays which rely on a binding agent. For example, aptamers can be used instead of antibodies in immune-based assays. This Example provides an aptamer screening method that identifies aptamers that do not bind to any surfaces (substrates, tubes, filters, beads, other antigens, etc.) throughout the assay steps and bind specifically to an antigen of interest. The assay relies on negative selection to remove aptamers that bind non-target antigen components of the final assay. The negative selection is followed by positive selection to identify aptamers that bind the desired antigen.

Preliminary experiments were done with five DNA aptamer libraries with $10^{15}$ sequences each and variable lengths (60, 65, 70, 75, 80-mers) were pre-amplified and strand separated so that forward strand (non-biotinylated) serves as an aptamer. Multiple rounds of negative selection and positive selection were performed. Before each round, the recovered aptamer products were PCR amplified and strand separated using standard methodology. Selections were performed as follows:

Negative Selection

1. Prepare bead negative Selection Mix: Incubate 1200 non-magnetic beads with standard blocking agent for 20 min.

2. Add 50 µl of aptamer library (5 libraries total) to a PCR strip tube with 4.5 µl of each bead mixture. Incubate for 2 h at 37° C. with agitation at 550 rpm.

3. Pre-wet filter plate (1.2 µm, Millipore) with PBS-BN buffer. Add 150 µl PBS-BN.

4. Transfer samples from the PCR strip tubes to the filter plate, incubate for 1 h at room temperature with agitation at 550 rpm.

5. Collect flow-through from filter plate into a collection (NBS) plate using a vacuum manifold.

6. Concentrate and clean samples to remove excess materials as desired.

The negative selection process is repeated up to 6-7 times.

Positive Selection

Before starting, conjugate the protein biomarkers of interest (here, SSx4, SSx2, PBP, KLK2, SPDEF) to desired non-magnetic microbeads using conditions known in the art. The recombinant purified starting material included: SPDEF recombinant protein from Novus Biologicals (Littleton, Colo., USA), catalog number H00025803-P01; KLK2 recombinant protein from Novus, catalog number H00003817-P02; SSx2 recombinant protein from Novus, catalog number H00006757-P01; PBP recombinant protein from Fitzgerald Industries International (Action, Mass., USA), catalog number 30R-1382; SSx4 recombinant protein from GenWay Biotech, Inc. (San Diego, Calif., USA), catalog number GWB-E219AC.

1. Bead blocking: Incubate a desired number of each bead (8400×number of aptamer libraries (5)× an overage factor of (1.2)) with a starting block for 20 min.

2. Mix 50 µl of each aptamer library sample to PCR strip tubes add 2.3 µl of bead sample with particular antigen. Incubate for 2 h at 37° C. with agitation at 550 rpm.

3. Pre-wet filter plate (1.2 µm, Millipore) with PBS-BN buffer. Add 150 µl PBS-BN.

4. Transfer samples from the PCR strip tubes to the filter plate, incubate for 1 h at room temperature with agitation at 550 rpm.

5. Wash 3× with PBS-BN, add 50 µl of PBS and collect samples from the top of the filter to the 1.5 ml tubes.

The positive selection is repeated up to 16 times. Certain rounds of positive selection have additional steps to treat the recovered RNA (i.e., remaining aptamer candidates) as follows:

Round 8 of positive selection was modified as follows:

1. After the third wash (PBS-BN) 25 µl of sample were collected from the top of the filter into 1.5 ml tubes.

2. The filter plate was incubated at 45° C. for ~10 min and washed immediately using vacuum. The plate was washed three more times with PBS-BN.

3. 50 µl of PBS were added to the plate and step 2 was repeated.

4. After the last wash, 25 µl of PBS was added to the wells. The samples were mixed well and collected from the top of the filter into 1.5 ml tubes.

Round 9 of positive selection was modified as follows:

1. After the final wash in step 5), 5 µg/ml Streptavidin-PE was added to the aptamer mixture and incubated for 30 min at room temperature with agitation at 550 rpm.

2. Samples on filter plate were washed 3× with PBS-BN (+additional 500 mM NaCl).

3. One additional wash with regular PBS-BN was performed.

4. 50 µl of PBS was added to the samples followed by collection as above into 1.5 ml tubes.

5. Samples stored at −20° C.

Round 14 of positive selection was modified as follows:

Before start this round, the antigens of interest (SSx4, SSx2, PBP, KLK2, SPDEF) were conjugated to carboxylated magnetic beads using methods known in the art.

1. Bead blocking: take desired number of each non-magnetic bead (3000×number of aptamer libraries (5)× an overage factor of 1.2), add starting block (3:1, blocking per 1200 beads), make 5 mixes of 4 antigens and supplement each with different target antigen conjugated to magnetic beads (see Table 6 below, wherein the antigens are conjugated to non-magnetic beads except as indicated), incubate 20 min.

TABLE 6

Bead blocking mixtures

| Blocking Mix | Non-magnetic bead antigens | Magnetic bead antigens |
|---|---|---|
| 1 | SSX4 + PBP + KLK2 + SPDEF | SSX2 |
| 2 | SSX2 + PBP + KLK2 + SPDEF | SSX4 |
| 3 | SSX2 + SSX4 + KLK2 + SPDEF | PBP |
| 4 | SSX2 + SSX4 + PBP + SPDEF | KLK2 |
| 5 | SSX2 + SSX4 + PBP + KLK2 | SPDEF |

2. Add 50 µl of aptamer libraries to PCR strip tubes, add bead mixtures with target antigen on magnetic beads to the tubes with pre-selected corresponding aptamer library and incubate for 2 h at 37° C. with agitation at 550 rpm.

3. Pre-wet filter plate with PBS-BN buffer, add 150 µl PBS-BN.

4. Transfer samples from PCR strip tubes to filter plate, incubate 1h room temperature with agitation at 550 rpm.

5. After last (standard) wash, add 5 µg/ml Streptavidin-PE, incubate for 30 min room temperature with agitation at 550 rpm;

6. Wash 3× with PBS-BN (+additional 500 mM NaCl).

7. Perform one additional wash with regular PBS-BN.

8. 50 µl of PBS was added to the samples followed by collection as above into 1.5 ml tubes.

9. Remove the magnetic beads using a magnetic stand, and replace with fresh PBS buffer.

10. Samples stored at −20° C. for subsequent DNA extraction and strand separation.

Optional steps implemented in the later round of positive selection are intended to increase stringency of aptamer binding (e.g., increased heat or salt concentration).

Example 8: Discovery and Characterization of Anti-EpCAM Aptamers

Figure 7C:
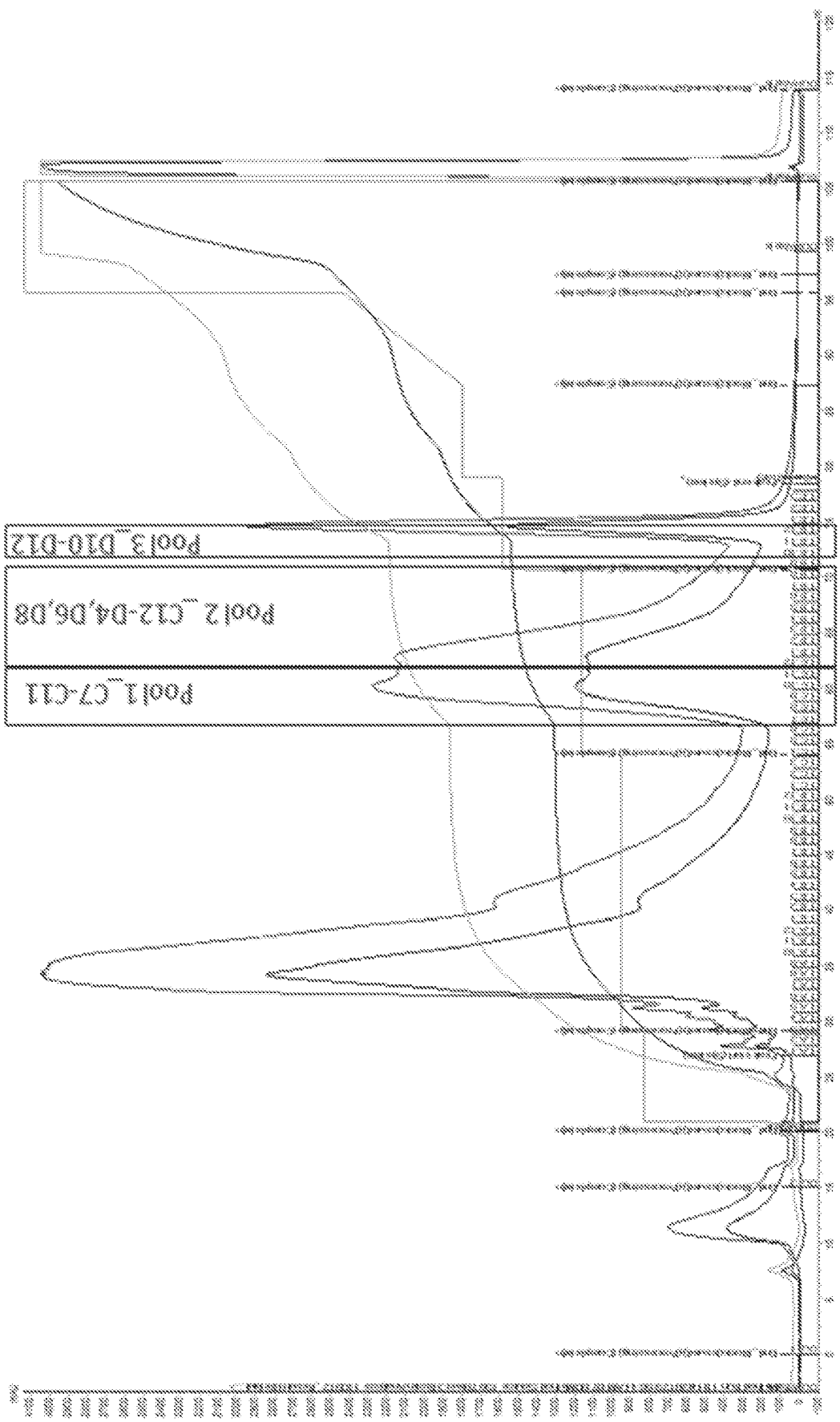
FIG. 7C illustrates aptamer pool purification. The figure comprises an FPLC chromatogram with all product and fractions assigned in pools after checking quality on gel.

In this Example, an aptamer to EpCAM identified using the technique in the Example above is characterized. After selection for a pool of EpCAM binding aptamers as described above, the aptamer library was sequenced using the Ion Torrent standard protocol (Life Technologies, Carlsbad, Calif.). Lead candidates were selected as those having (a) high abundant motifs across all read sequences with full expected length product and (b) strong secondary structure (FIG. 7B).

Aptamers wre selected for EPCAM protein conjugated to MicroPlex beads in competition with SSx4, SSx2, PBP, KLK2, and SPDEF recombinant proteins. A portion of the aptamers was selected in initial rounds against EpCAM that was attached to an Fc tag, and after round 8 the selection was switched to EPCAM with a Histidine tag. Another portion of the aptamers was selected in initial rounds against EpCAM that was attached to a Histidine tag, and after round 8 the selection was switched to EPCAM with an Fc tag. Methods of using Fc and histidine tags for protein purification and capture are known to those of skill in the art.

Aptamer Characterization

CAR003 is an aptamer candidate identified using the above methodology. As an RNA aptamer, CAR003 with alternate tail sequence has the following RNA sequence (SEQ ID NO. 5):

5'-auccagagug acgcagcagu cuuuucugau ggacacgugg uggucuagua ucacuaagcc accgugucca-3'

CAR003 was further characterized. EpCAM aptamer CAR003 is modified as desired by attachment of a biotin moiety on the 5'end or 3' end. The biotin can be used to bind the aptamer using a streptavidin-biotin system, e.g., for labeling, capture and/or anchoring. FIG. 7B illustrates the optimal secondary structure of CAR003 with a minimum free energy (ΔG) of −30.00 kcal/mol. For purposes of illustration, the aptamer is shown as an RNA aptamer (SEQ ID NO. 5) corresponding to the CAR003 DNA sequence (SEQ ID NO. 4).

Figure 7D:
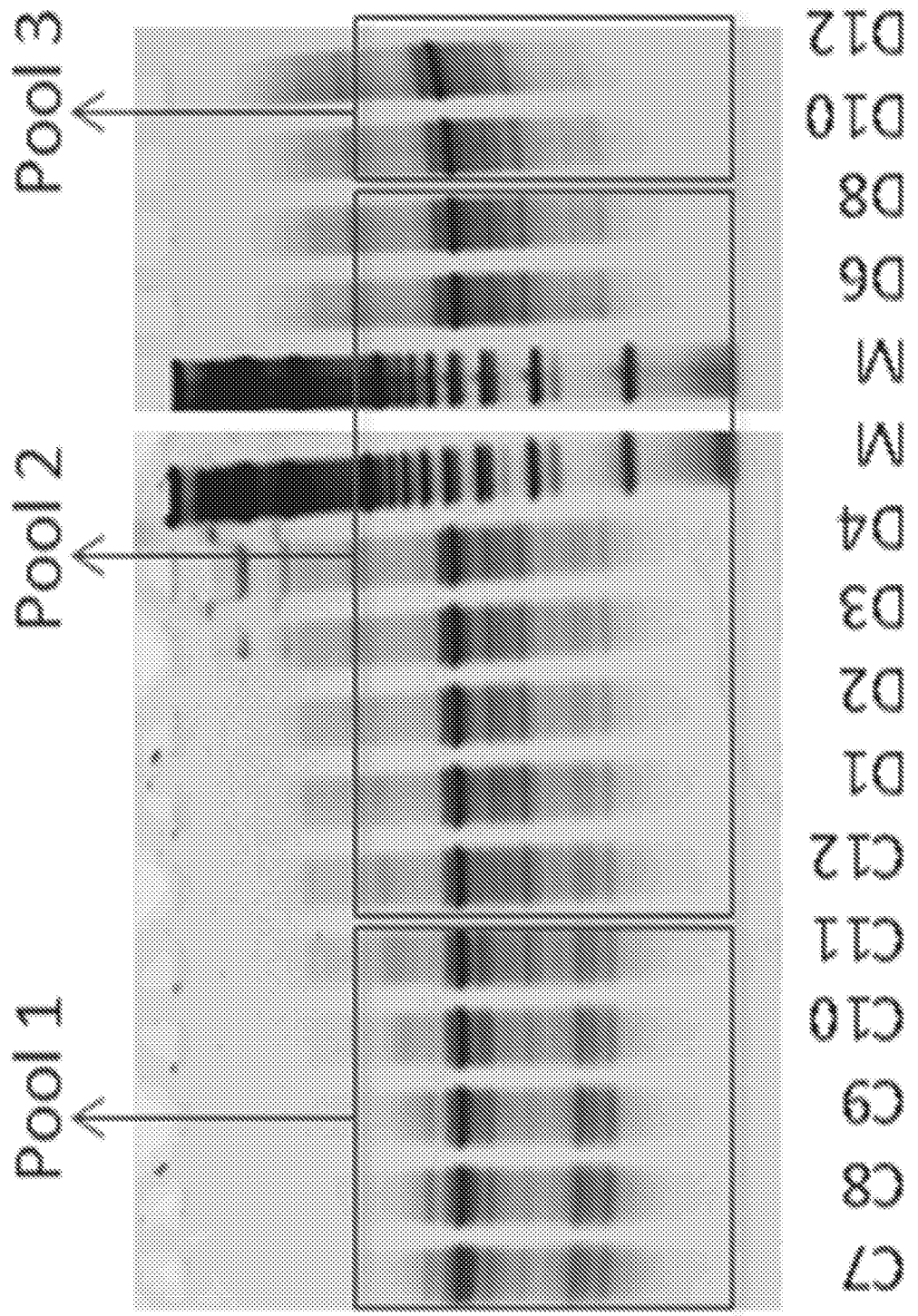
FIG. 7D illustrates a SYBR GOLD stained gel with different FPLC fractions of CAR003 aptamer after synthesis. Different fractions were combined in pools based on amount of un-finished chains in order high to low (pool 1-pool 3). The pools 1-3 correspond to those indicated in FIG. 7C.

Synthesis and purification. The selected CAR003 aptamer was re-synthesized using AKTA OligoPilot 100 Synthesizer (GE Healthcare Life Sciences Corp., Piscataway, N.J.) with a 3'Biotin and final detritylation. The product was purified with anion exchange chromatography by FPLC. Several fractions after FPLC were combined as shown as the indicated Pools 1-3 in FIG. 7C. The figure comprises an FPLC chromatogram with all product and fractions assigned in pools after checking quality on gel. FIG. 7D illustrates a SYBR GOLD stained gel with different FPLC fractions of CAR003 aptamer after synthesis. Different fractions were combined in pools based on amount of unfinished chains in order high to low (pool 1-pool 3). The pools 1-3 correspond to those indicated in FIG. 7C.

Figure 7E:
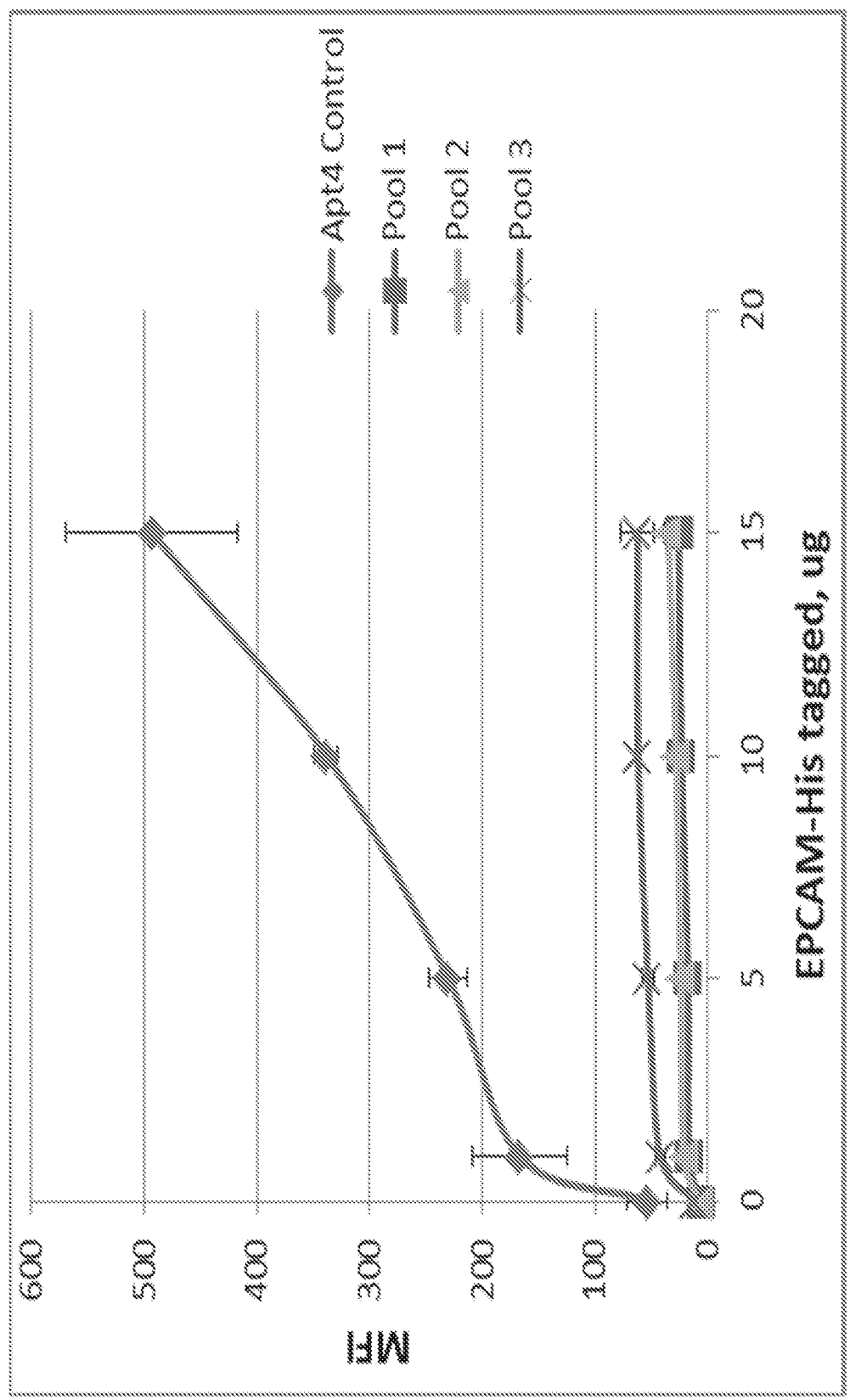
FIG. 7E-F illustrate binding of CAR003 to EPCAM protein in 25 mM HEPES with PBS-BN (FIG. 7E) or in 25 mM HEPES with 1 mM $MgCl_2$ (FIG. 7F).
Figure 7F:
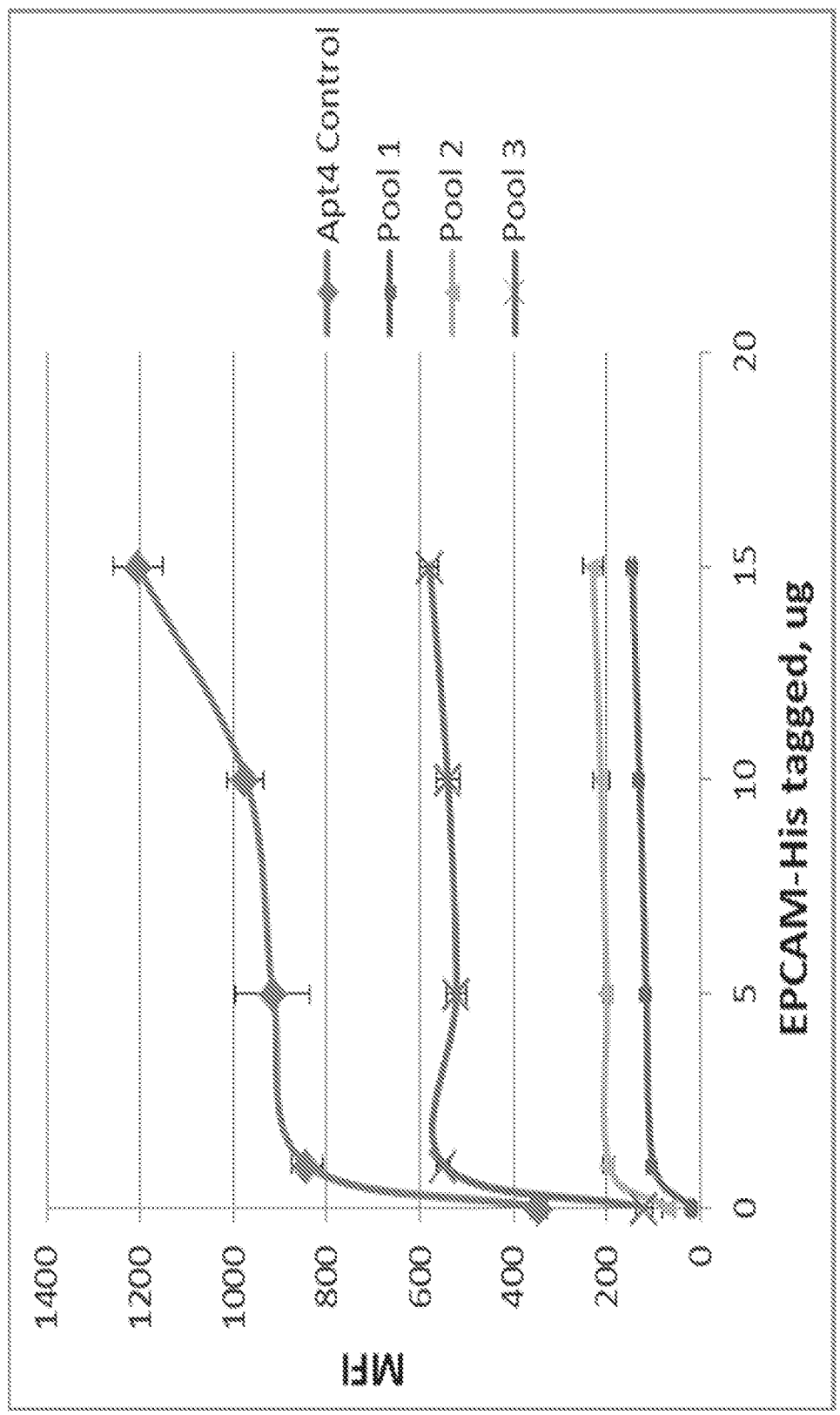

CAR003 aptamer characterization. Purified CAR003 aptamer was tested for binding to recombinant EPCAM protein with a polyhistidine tag ("His tagged") using the following internally developed assay. Anti-His tag conjugated beads were mixed with EPCAM-His tagged protein. The aptamer to be tested was labeled with streptavidin-phycoerythrin (SA-PE). The EpCAM-beads and SA-PE labeled aptamers were mixed. Binding was determined as median fluorescent value in a bead assay as described herein. MFI values (FIG. 7E-F) increase with increased binding of the SA-PE labeled aptamer to the recombinant EpCAM. FIG. 7E-F illustrate binding of CAR003 to EPCAM protein in 25 mM HEPES with PBS-BN (PBS, 1% BSA, 0.05% Azide, pH 7.4) (FIG. 7E) or in 25 mM HEPES with 1 mM MgCl₂ (FIG. 7F). EPCAM aptamer Aptamer 4 (see above) was used for comparison. As shown in the figures, CAR003 pool 3 more efficiently binds its target in the presence of MgCl₂ (FIG. 7F) than in the presence of BSA (FIG. 7E).

Figure 7G:
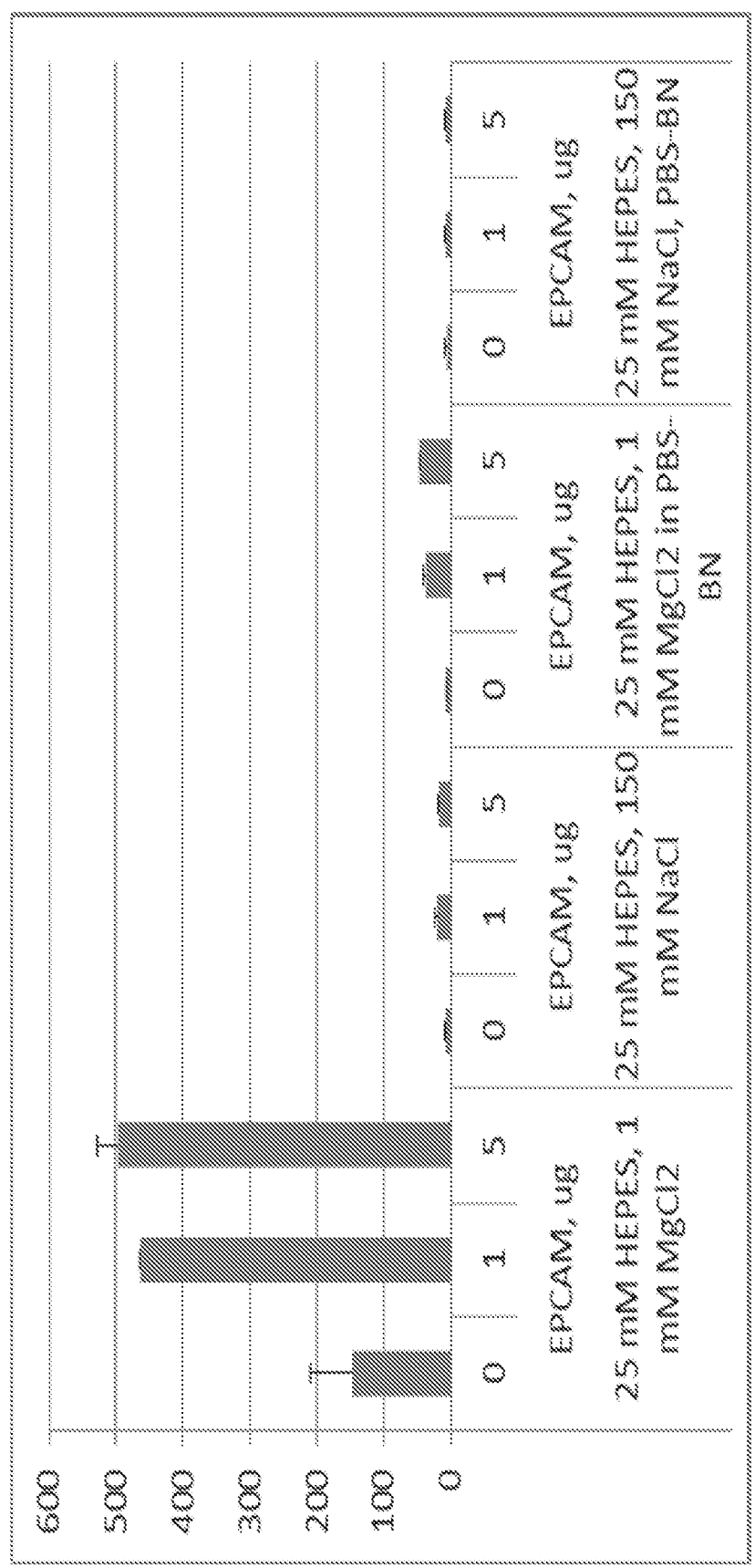
FIG. 7G illustrates CAR003 binding to EpCAM in the indicated salts with and without addition of bovine serum albumin (BSA).

To understand its performance further, CAR003 binding was tested in the presence of both BSA and MgCl₂ in various buffers. FIG. 7G illustrates CAR003 binding to EpCAM in the indicated salts with and without addition of bovine serum albumin (BSA). Again, CAR003 binding to EpCAM is more efficient when BSA is not present. Additionally, 150 mM NaCl was tested but did not appear to improve CAR003 performance over MgCl₂.

Figure 7H:
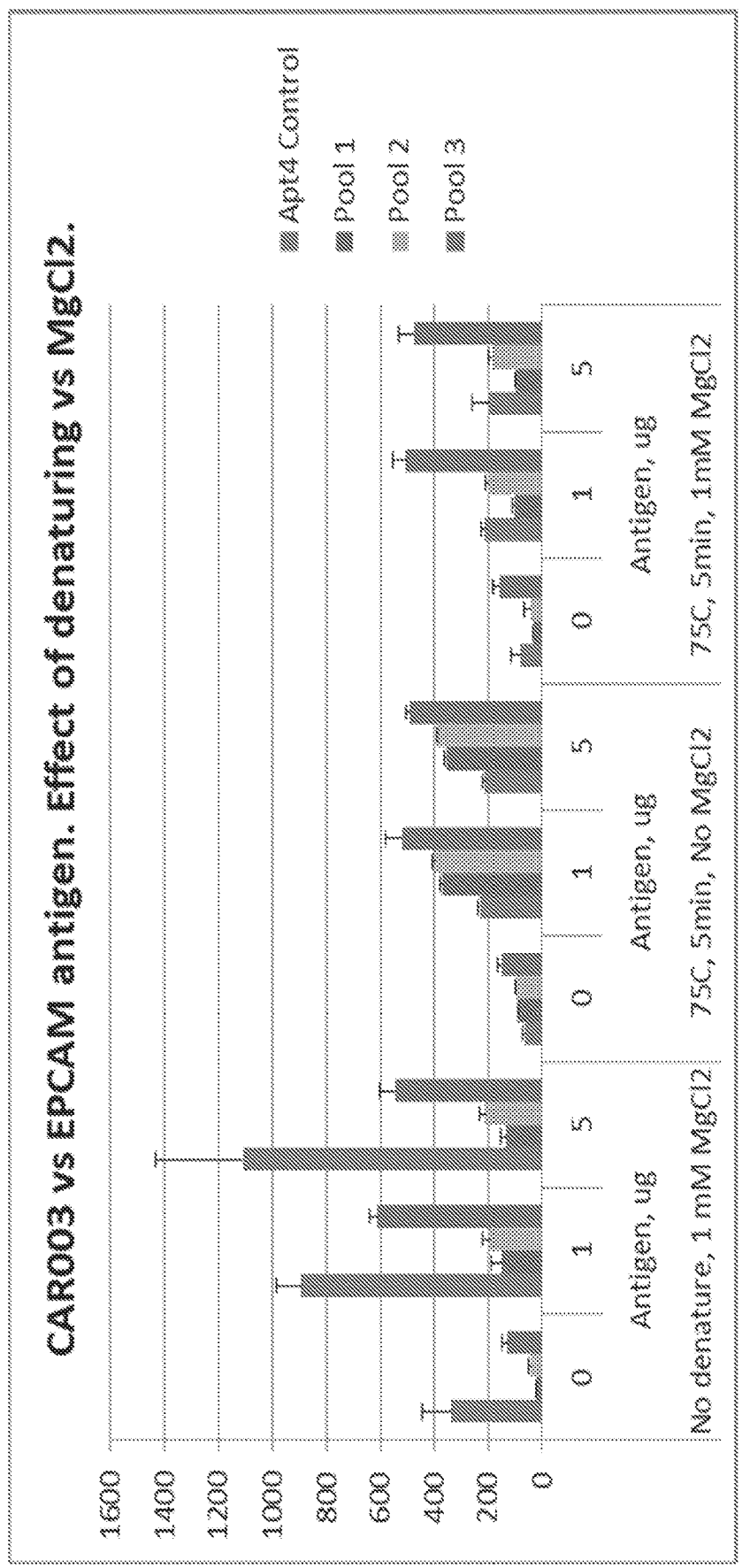
FIG. 7H illustrates the effect of denaturing on CAR003 binding to EPCAM protein. In each group of four bars, the aptamer is from left to right: Aptamer 4, CAR003 Pool 1, CAR003 Pool 2, CAR003 Pool 3.

Another factor which might influence performance of aptamer is denaturing with different salt compositions. FIG. 7H illustrates the effect of denaturing on CAR003 binding to EPCAM protein. As seen from the chart, denaturing of the aptamer has a positive effect on CAR003 binding to EpCAM similar as the effect on CAR003 from MgCl₂. However, denaturing in the presence of MgCl₂ may not synergistically improve binding of CAR003 to EpCAM. Interestingly, CAR003 appeared more stable compared to control Aptamer 4 in the conditions tested.

Figure 7I:
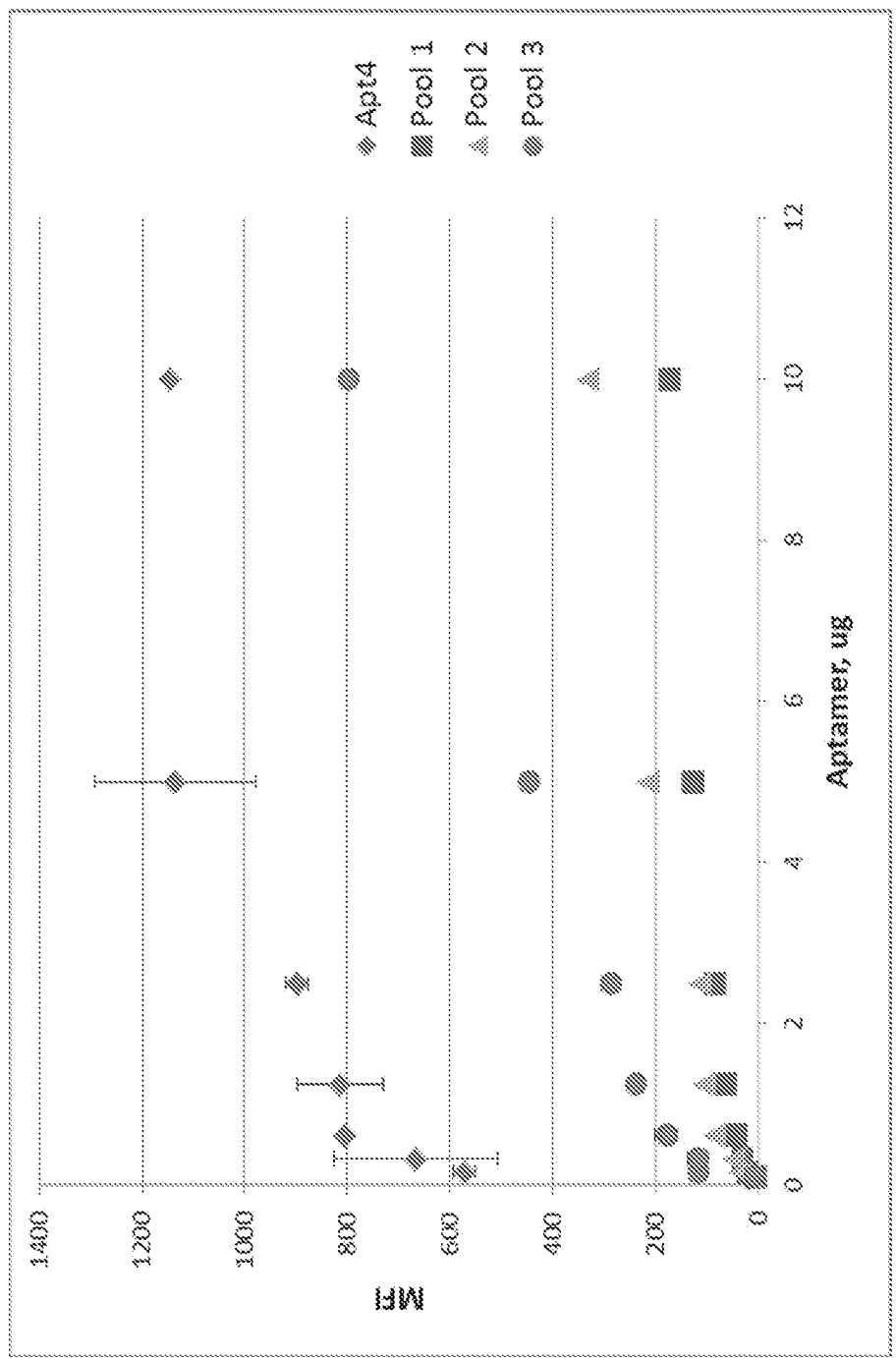
FIG. 7I illustrates titration of aptamers against EPCAM recombinant protein (constant input 5 μg).

CAR003 affinity to EpCAM in the bead assay environment was assessed in the same assay as above with aptamer titrated across a constant input of antigen. FIG. 7I illustrates titration of aptamers against EPCAM recombinant protein (constant input 5 μg). Under the conditions tested, Aptamer 4 had a higher affinity to EPCAM protein compared to CAR003 as suggested from saturation level starting at 5 μg of aptamer input.

Figure 7J:
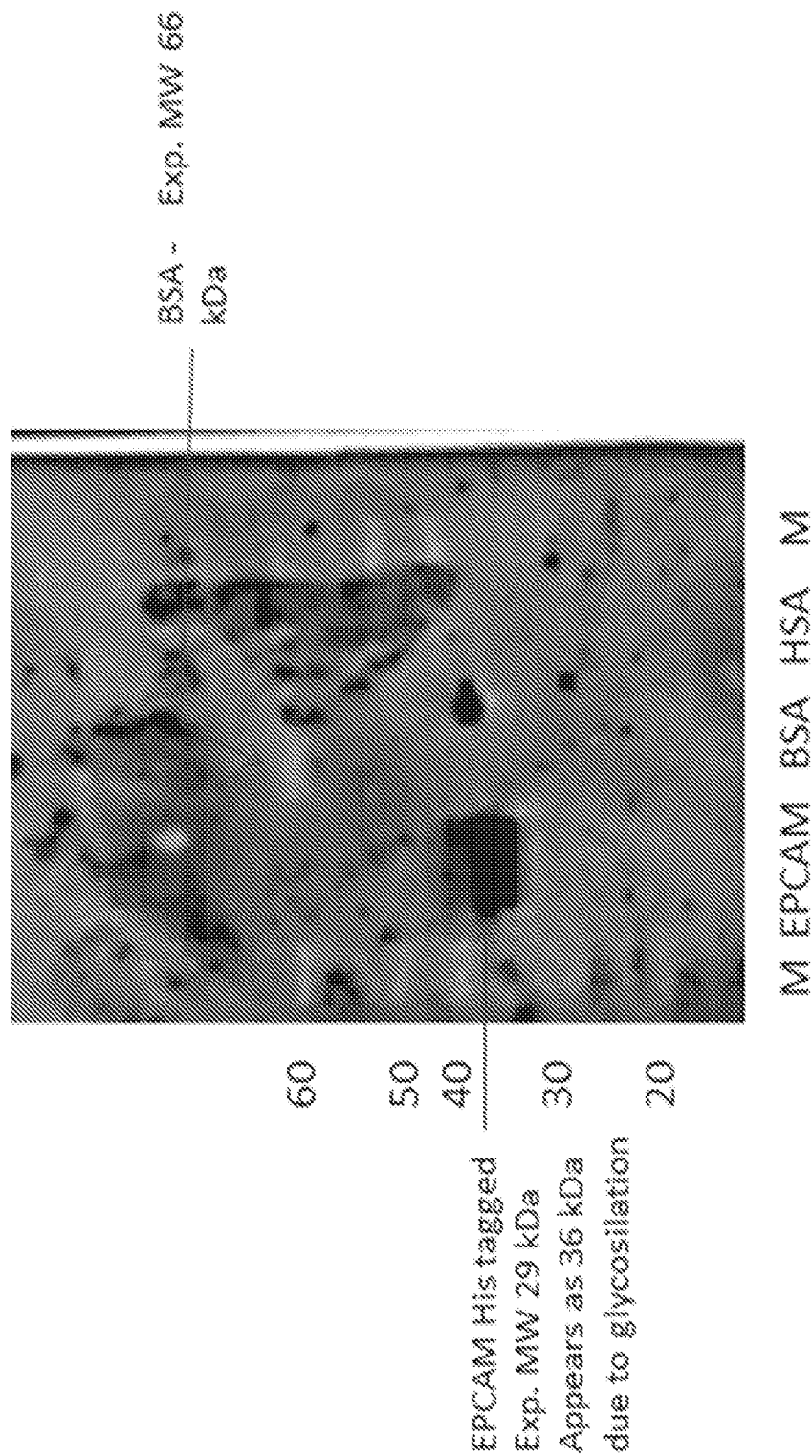
FIG. 7J illustrates a Western blot with CAR003 aptamer versus EPCAM his-tagged protein, BSA, and HSA (5 μg each). The gel was blocked 0.5% F127 and probed with ~50 μg/ml CAR003 biotinylated aptamer, fraction 3. The blot was visualized with NeutrAvidin-HRP followed by SuperSignal West Femto Chemiluminescent Substrate.

In order to evaluate specificity of CAR003, it was tested using Western Blot against EPCAM recombinant protein, and controls comprising bovine serum albumin (BSA) and human serum albumin (HSA). FIG. 7J illustrates a Western blot with CAR003 aptamer versus EPCAM his-tagged protein, BSA, and HSA (5 μg each). The gel was blocked 0.5% F127 and probed with ~50 μg/ml CAR003 biotinylated aptamer, fraction 3. The blot was visualized with NeutrAvidin-HRP followed by SuperSignal West Femto Chemiluminescent Substrate. The Western blot probed with CAR003 aptamer showed a clear preference of the aptamer to EPCAM protein over the albumins.

CAR003 test with plasma samples. Plasma samples from five prostate cancer and five normal subjects were tested with CAR003 to detect microvesicles using bead-conjugated proteins to capture the microvesicles and SA-PE labeled aptamer to detect the vesicles. SA-PE labeled Aptamer 4 detector was used as control. Fold changes of Cancer over Normal are shown in Table 7. The fold changes are shown without normalization ("Raw") or with normalization to a negative control. The vesicles were captured with bead conjugated antibodies to SS×4, PBP, SPDEF, EPCAM, KLK2 and SS×2 as indicated.

TABLE 7

| | | CAR003 to detect microvesicles | | | | | |
|---|---|---|---|---|---|---|---|
| | | SSX4 | PBP | SPDEF | EPCAM | KLK2 | SSX2 |
| Raw | Standard protocol | 0.87 | 0.39 | 0.71 | 0.63 | 0.93 | 0.87 |
| | Incubation in presence of 1 mM MgCl2 and absence of PBS-BN | 0.77 | 0.39 | 0.69 | 0.6 | 0.91 | 0.81 |
| | Aptamer 4 control (standard protocol) | 0.78 | 0.67 | 0.81 | 0.72 | 1.19 | 0.79 |

TABLE 7-continued

| | | CAR003 to detect microvesicles | | | | | |
|---|---|---|---|---|---|---|---|
| | | SSX4 | PBP | SPDEF | EPCAM | KLK2 | SSX2 |
| Normalized to Negative control | Standard protocol | 1.49 | 0.84 | 1.13 | 1.17 | 1.5 | 1.38 |
| | Incubation in presence of 1 mM MgCl2 and absence of PBS-BN | 1.27 | 0.83 | 1.08 | 1.1 | 1.46 | 1.29 |
| | Aptamer 4 control (standard protocol) | 1.18 | 0.96 | 1.11 | 1.04 | 1.82 | 1.1 |

Under the conditions tested, the samples detected with CAR003 had lower MFI values as compared to detection with Aptamer 4, whereas CAR003 had a better signal-to-noise ratio and showed better separation between cancer and normal samples with SS×4, SPDEF, EPCAM and SS×2 capturing markers.

Control Aptamer

The characteristics of the aptamers (size, stability, binding affinity and specificity, etc) can be compared against control aptamers specific to EpCAM or other targets. For example, the aptamers are compared to the anti-VEGF aptamer 5' biotin-CA ATT GGG CCC GTC CGT ATG GTG GGT (SEQ ID NO. 7) as described in Kaur and Yung, 2012.

REFERENCES

1) Müller, J., et al. "Selection of high affinity DNA-aptamer for activated protein C using capillary electrophoresis." *Research in Pharmaceutical Sciences* 7.5 (2012): S987.

2) Cerchia, L., and V. de Franciscis. "Nucleic Acid Aptamers Against Protein Kinases." *Current medicinal chemistry* 18.27 (2011): 4152-4158.

3) Wu, Jie, et al. "Identification, Characterization and Application of a G-Quadruplex Structured DNA Aptamer against Cancer Biomarker Protein Anterior Gradient Homolog 2." *PloS ONE* 7.9 (2012): e46393

4) Mitkevich, Olga V., et al. "DNA aptamers detecting generic amyloid epitopes." *Prion* 6.4 (2012): 400-406.

5) Kaur H, Yung L-YL (2012) Probing High Affinity Sequences of DNA Aptamer against $VEGF_{165}$. PLoS ONE 7(2): e31196. doi:10.1371/journal.pone.0031196.

Example 9: Aptamer Target Identification

In this Example, aptamers conjugated to microspheres are used to assist in determining the target of two aptamers identified by library screening methods as described above. The general approach is shown in FIG. 9. The approach is used to verify the targets of CAR003, an aptamer identified by library screening to recognize EpCAM. See description above for CAR003. In this approach, the sequence of CAR003 is randomly rearranged before linkage to the microspheres. The microspheres are used as controls to bind to targets that are similar but not identical to the intended target molecule.

The protocol used is as follows:

1) The candidate aptamers (here, CAR003) and negative control aptamers (here, randomly arranged CAR003) are synthesized with modifications to allow capture (here, the aptamers are biotinylated) and crosslinking (here, using the Sulfo-SBED Biotin Label Transfer Reagent and Kit, Catalog Number 33073 from Thermo Fisher Scientific Inc., Rockford, Ill., to allow photocrosslinking).

2) Each of the aptamers is individually mixed with microvesicles having the target of interest (here, BrCa cell line microvesicles).

3) After incubation to allow the aptamers to bind target, ultraviolet light is applied to the mixtures to trigger crosslinking of the aptamers with the microvesicle targets.

4) The microvesicles are lysed, thereby releasing the crosslinked aptamer-target complex into solution.

5) The crosslinked aptamer-target complexes are captured from solution using a streptavidin coated substrate.

6) The crosslinked aptamer-target complexes for each aptamer are run individually on SDS-PAGE gel electrophoresis. The captured protein targets are visualized with Coomasie Blue staining.

7) The crosslinking and binding steps may be promiscuous so that multiple bands including the intended target but also random proteins will appear on each of the gels. The intended target will be found in a band that appears on the gel with the candidate aptamer (here, CAR003) but not the related negative control aptamers (here, randomly arranged CAR003). The bands corresponding to the target are excised from the gel.

8) Mass spectrometry (MS) is used to identify the aptamer target from the excised bands.

Example 10: Aptamers to Breast Cancer (BrCa) Derived Microvesicles

In this Example, an aptamer library is screened to identify aptamers that distinguish between microvesicles circulating in the blood of breast cancer patients and microvesicles circulating in the blood of healthy, control individuals (i.e., without breast cancer).

Microvesicles were isolated from plasma of a pool of 60 breast cancer patients (BrCa+). Microvesicles were also isolated from pool of 60 non-cancer samples (BrCa−). Microvesicles were isolated from the plasma using ultracentrifugation (120,000×g). Microvesicles were in the pellet from the ultracentrifugation. The supernatant from the ultracentrifugation was saved to use as a control. The microvesicles from both sample types were conjugated to MagPlex beads (Luminex Corp, Austin Tex.). Optionally, the isolated microvesicles are incubated with anti-HSA/IgG/Fibrinogen beads to remove these highly abundant blood proteins. However, the conjugation step can be optimized to favor conjugation of the microvesicles such that removal of highly abundant proteins may be less of an issue.

The aptamer library used consisted of a 2'F SUL1 RNA aptamer library. The sequence is 5'-GGGAGGAC-GAUGCGG-N40-CAGACGACUCGCUGAGGAUC-CGAGA-3' (SEQ ID NO. 8). The aptamer library consists of three sections: Forward primer—15 nucleotides, variable region—40 nucleotides; reverse primer—25 nucleotides. All pyrimidines (C and U) were 2'Fluoro modified.

The aptamer library was incubated with either the cancer or control microvesicle-conjugated beads. Thirteen rounds of positive selection for aptamers that bind the microvesicles were performed in parallel for both types of samples. See Example 11 below for detailed protocol of the positive selection steps. Negative selection was not performed.

A number of representative sequences obtained from these procedures are shown in Table 8. The sequences in the table were identified in the aptamer pools from selection against BrCa microvesicles but were not in the aptamer pools selected against non-cancer samples. In Table 8, the sequences are shown 5' to 3' from left to right, wherein each complete sequence consists of a 5' leader sequence 5'-GGGAGGACGAUGCGG (SEQ ID NO. 9) followed by the indicated Variable Sequence followed by the 3' tail sequence 5'-CAGACGACUCGCUGAGGAUCCGAGA (SEQ ID NO. 10). Each sequence is derived from a library having a leader and tail (see description above) with a variable sequence between. It is understood that the nucleotide sequences that are disclosed in Table 8 can also be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to microvesicle antigens or functional fragments thereof.

TABLE 8

BrCa microvesicle aptamer candidate sequences

| ID | SEQ ID NO. | Variable Sequence |
|---|---|---|
| BRCA_APT1_RNA | 11 | CGCGUCUUCCCCGCAUUGCCGCAAUUGCCAUACAUUAAUA |
| BRCA_APT2_RNA | 13 | GUCCGGAACGCCUCGAUCCUCGCAUAAUAUGAUACGUCUG |
| BRCA_APT3_RNA | 15 | GUCCAUGGUACGCCUCGAUUCCGCCCAUACAUGCAUGUAA |
| BRCA_APT4_RNA | 17 | CACUAUCCGUUUGUCCGUCCUCUUGUGGUAUUGCGCAUGC |
| BRCA_APT5_RNA | 19 | UCUUCCAUCUGGUCGCGAUACAGAAUACGAUUAACAUAAA |
| BRCA_APT6_RNA | 21 | GAUCACGCUGCCCUUUGUUUAAGGCCUUUAUACAAACGCA |
| BRCA_APT7_RNA | 23 | UAUUCGCCAGUCACAUCAACUAUGAUGACGCUUGACUGGA |

Each sequence in Table 8 is synthesized in two variants for further investigation: 5' biotinylated and 3' biotinylated. This provides aptamer variants that can be captured at the 5' end or the 3' end as desired. The aptamers are further synthesized with each pyrimidine (C and U) 2'Fluoro modified.

The DNA sequence corresponding to each RNA sequence in Table 8 is provided in the sequence listing, where the DNA sequence directly follows its corresponding RNA sequence. For example SEQ ID NO. 12 is the DNA sequence corresponding to RNA sequence SEQ ID NO. 11, etc. The DNA forms of the aptamers are synthesized for further characterization as well.

The aptamers above were identified using positive selection for aptamers which recognize BrCa and non-BrCa microvesicles conjugated to microspheres.

Example 11: Aptamer Library Selection Protocol

This Example provides the protocol for SUL1 RNA library selection performed in the Example above. The protocol can be followed for other aptamer libraries and sample input as desired.

Preparation

The working space is cleaned with 80% EtOH before working.

Beads are MagPlex beads (Luminex Corp., Austin, Tex.). Other beads can be substituted as desired.

Buffers/Reagents to Prepare:
MilliQ water
100 mM $MgCl_2$
5× Transcription Buffer (200 mM Tris pH 7.9)
1×PBS
1×PBS with 3 mM $MgCl_2$
10×PBS
Selection buffer (1×PBS with 0.1% BSA and 3 mM $MgCl_2$)

Before starting with selection, remove the bead storage buffer, and wash beads with 1×PBS w/3 mM $MgCl_2$ 1 times (200 uL total in all 4 tubes). 200,000 beads per selection are used.

Binding 2'F SUL1 RNA pool to microvesicle coated magnetic beads

Abbreviations: TK—Transcription; NTC—No template control.

Steps:
1. $1^{st}$ Round: Mix 1 nmol purified 2'F SUL1 RNA with 20 μl of resuspended beads (conjugated with microvesicle). 10 uL of 10×PBS+1% BSA, 3 μl 100 mM $MgCl_2$, and 47 uL $H_2O$. This gives a final concentration of 1×PBS, 0.1% BSA, 3 mM $MgCl_2$.
    1.1 The addition of $MgCl_2$ in this step gives a concentration of 3 mM $MgCl_2$. This is the binding concentration for the entire process.
    1.2 Following Rounds: Mix 20 μl of transcription product (15 mM $MgCl_2$ inside) with 20 μl of washed microvesicle coated beads, plus 9 uL 10×PBS with 1% BSA, 51 uL $H_2O$. No additional $MgCl_2$ is needed because the $MgCl_2$ in the diluted transcription product (TK) provides a final concentration of 3 mM $MgCl_2$.
2. Incubate for 30 min at 37° C., shake at 1000 rpm, and pipet mix every 10 minutes.
3. Wash the beads:
    3.1 One washing cycle comprises:
        3.1.1 Remove the beads from the magnet
        3.1.2 Resuspend beads in 100 μl 1×PBS +3 mM $MgCl_2$ off the magnet.
        3.1.3 Incubate sample for 30 seconds off of the magnet.
        3.1.4 Place the sample back onto the magnet, and wait until the beads are on the side.
        3.1.5 Remove and discard the supernatant.
        3.1.6 Resuspend in 100 μl 1×PBS+3 mM $MgCl_2$+ 0.1% BSA off of the magnet.
        3.1.7 Incubate sample for 3 minutes off of the magnet.
        3.1.8 Place the sample back onto the magnet, and wait until the beads are on the side.
        3.1.9 Remove and discard the supernatant
    3.2 $1^{st}$ Round: Place bead mixture on a magnet and remove the supernatant. Wash once with 100 μl 1×PBS+3 mM $MgCl_2$+0.1% BSA (by pipette mixing the beads), and discard buffer.

3.3 Following Rounds: Increase the washing steps every second round by one more washing step up to 3 washing steps.
4. Add 55 µl MilliQ water to the bead sample.
5. Elute the RNA by incubating the bead sample for 5 min at 80° C.
   5.1 Check if there is 50 µl, if not spin the sample down to spin down the condensed water off the top.
   5.2 Transfer the supernatant to a new vial. Work quickly to avoid the strands rebinding the beads.
   5.2.1 Use 50 µl eluate for the following RT-PCR and store the rest at −20° C.

RT-PCR of Recovered Aptamer Candidates

Tips

The rest of the RT-PCR sample and the TK-PCR sample is stored at −20° C.
RNA can be stored at 4° C. for ~1 h
RT-PCR product can be stored overnight at 4° C.
Proceed to the next selection cycle for optimal RNA quality immediately after transcription.
Avoid vortexing RNA
Mix on ice
Use 0.5 ml PCR tubes
Every RT-PCR should have a no-template control (NTC) with water instead of template
Do not freeze-thaw DTT more than one time
6. Prepare a Master Mix before the first round per Table 9, check it with 0.5 pmol RNA and store aliquots of 48 µl at −20° C. until usage.

TABLE 9

RT-PCR master mix

| Reagent | Volume (µl)/reaction | Final concentration |
| --- | --- | --- |
| 5x Colorless GoTaq Flexi Buffer Promega cat# M890A | 20 | 1x |
| 5x first strand buffer (Invitrogen) lot# 1300427 | 4 | 0.2x |
| 100 mM DTT | 2 | 2 mM |
| 100 µM SUL1 F primer | 1 | 1 µM |
| 100 µM SUL1 R primer | 1 | 1 µM |
| 100 mM MgCl$_2$ | 1.5 | 1.5 mM |
| 25 mM (each) dNTPs | 1.2 | 300 µM |
| MilliQ water | 17.3 | |
| Total | 48 | |

7. Add 50 µl MilliQ water as negative control (NTC) (pipette this first) or 50 µl selection eluate. Pipet mix.
8. Incubate at 65° C. for 5 min.
9. After cooling to 4° C., add:
   9.1 1 µl Superscript II Reverse Transcriptase (Invitrogen, cat #18064) (200 U/µl)
   9.2 1 µl GoTaqFlexi DNA polymerase (5 units/µl) Promega cat #M8305.

PCR—Program (SARTPCR)
a) 10 min 54° C.
(This step is only for reverse transcriptase, should more rounds be needed, do not repeat step A.)
b) 1 min 95° C.
c) 1 min 60° C.
d) 1 min 72° C.
10. Cycle steps b-d for
10.1 1$^{st}$ round b-d 4 cycles. Run 5 µL PCR products on a 4% agarose gel.
   10.1.1 Subsequent rounds: The amount of RNA is decreased after the first round, leading to an increase in required PCR-cycles. To determine the number of cycles needed each time, check the band intensity from the agarose gel from the previous round of selection. Use that number of cycles to start the next round of RT-PCR. Note: Always check results on an agarose gel.
      10.1.1.1 Agarose gel results: product band should be seen at the target length. The band intensity should be about the same as the 50 bp ladder band (if not a little less intense). If the band is not intense enough (barely visible), cycle an appropriate amount more and re-check on an agarose gel.

Transcription

All mixing performed on ice. Prepare transcription Master Mix per Table 10 and store aliquots of 85.7 µl at −20° C. until use.
11. Verify pH of stock 200 mM Tris pH 7.9 before use. A change in pH over time may cause problems with the transcription.

TABLE 10

Transcription (TK) Master Mix for SUL1 library

| Reagent | Volume (µl) for one reaction | Volume (µl) for 20 reactions | Final concentration |
| --- | --- | --- | --- |
| 5x Transcription buffer (200 mMTris, pH 7.9) | 20 | 400 | 1x |
| 100 mM DTT | 5 | 100 | 5 mM |
| 100 mM ATP | 1 | 20 | 1 mM |
| 100 mM GTP | 1 | 20 | 1 mM |
| 100 mM 2'F-dUTP | 3 | 60 | 3 mM |
| 100 mM 2'F-dCTP | 3 | 60 | 3 mM |
| 100 mM MgCl$_2$ | 15 | 300 | 15 mM |
| MilliQ water | 37 | 740 | |
| Total volume | 85 | 1700 µl | |

12. Add 10 µl RT-PCR product to the mastermix.
13. Add 1 µl RNasin (40 units/µl)
   13.1 Promega Recombinant RNasin Ribonuclease Inhibitor cat #N2515/N2511
14. Add 4 µl T7 Y639F mutant polymerase (25 U/µl use: 100 U total per reaction)
15. Perform the reaction for 30 min at 37° C.
16. Use the transcription-product directly for the next selection round. If the next step is not feasible, freeze transcription product at −20 C.

Subsequent Rounds

Repeat the bead incubation, the RT-PCR and transcription as often as needed. Try to have similar band intensity of the RT-PCR product for the sample in all rounds as noted above.

Binding Assay

A binding assay is performed after desired rounds of selection to determine to assess non-specific binding of cancer selected aptamers to control beads (conjugated to supernatant from plasma ultracentrifugation, see above) and likewise for non-cancer control samples. Binding assays can also be performed to assess binding of selected aptamers against the intended target microvesicles.

Cherenkov protocol: Performed using $^{32}$P radioactively labeled aptamer library.

Final concentration of selection buffer: 1×PBS+ 3 mM MgCl$_2$+0.01% BSA pH 7.4

Wash buffer: 1×PBS+3 mM MgCl$_2$ pH 7.4

1. Remove microvesicle samples from −80° C. freezer and thaw.

2. Place beads on magnet (200,000 per sample experiment), remove bead storage buffer.
3. Wash 1× 200 µL for 1 minute each with 1×PBS, 3 mM MgCl₂ buffer. Pool beads to make 200,000 in one tube.
4. Resuspend beads in 70 µL of the selection buffer. (10 µl of 10×PBS, 1% BSA+3 µL 100 mM MgCl₂+57 µL H₂O per sample).
5. Add 30 µL radioactively labeled RNA aptamer library to their respective sample.
6. Incubate shaking at 1000 rpm at 37° C. for 30 min.
7. Place samples on a magnet.
8. Remove and save supernatant.
9. Wash beads with 200 µL wash buffer 1×PBS 3 mM MgCl₂ pH 7.4, incubating off the magnet for 3 minute.
10. Place samples on the magnet, remove and save wash solution.
11. Repeat steps 9, 10.
12. Add 100 µL water to the sample, pipette mix.
13. Heat at 80° C. for 5 minutes.
14. Place samples on a magnet, remove supernatant, and save.
15. Resuspend beads in 100 µL water.
16. Measure radioactivity of every fraction using scintillation counter.
17. Analyze amount of background binding present.

Negative Selection

As desired, a negative selection step is added prior to incubating the aptamer library with the beads conjugated to the target microvesicles (i.e., procedure "*Binding 2'F SUL1 RNA pool to microvesicle coated magnetic beads*" above). The negative selection can be performed using beads conjugated to the supernatant or the input samples (e.g., plasma) after microvesicles are filtered or sedimented from the sample (referred to as "no microvesicle coated beads," "microvesicle depleted samples," or similar). The steps are:

1) Start with aptamer library product from the desired round after transcription as described above. Wash the beads before start: remove storage buffer, wash beads with 200 µL wash buffer, then replace buffer as stated below:

2) Negative selection step: Add and pipet mix 20 µl of transcription product (15 mM MgCl₂) with freshly washed 'no microvesicle' coated beads with 10 µL 10×PBS with 1% BSA, 70 µL H₂O. No additional MgCl₂ is needed because the MgCl₂ in the diluted transcription product (TK) provides a final concentration of 3 mM MgCl₂.

3) Incubate for 30 min at 37° C., shake at 1000 rpm.

4) Remove supernatant and add it to the positive selection beads (directly), which are washed microvesicle coated beads.

Continue with positive selection incubation. See *Binding 2'F SUL1 RNA pool to microvesicle coated magnetic beads* above, starting at step 2. Additional steps through transcription are as detailed above.

Example 12: Additional Aptamers to Breast Cancer (BrCa) Derived Microvesicles In this Example, an aptamer library is screened to identify aptamers that distinguish between microvesicles circulating in the blood of breast cancer patients and microvesicles circulating in the blood of healthy, control individuals (i.e., without breast cancer). The procedure used the same samples and aptamer library as in Example 10 above. The procedure in this Example differs in that negative selection was performed before each positive selection starting after the third round of positive selection.

Negative selection serves to remove aptamers that bind soluble/abundant/non-informative and common proteins for cancer and non-cancer proteins. Negative selection include performing negative selection on the aptamer candidates selected against BrCa+ microvesicles as follows: (i) using microbeads conjugated to the supernatant from the BrCa+ plasma ultracentrifugation step (which should not contain microvesicles); (ii) using microbeads conjugated to the supernatant from the BrCa– plasma ultracentrifugation step (which should not contain microvesicles); (iii) using microbeads conjugated to BrCa– microvesicles. Negative selection can also be performed on the aptamer candidates selected against BrCa– microvesicles as follows: (i) using microbeads conjugated to the supernatant from the BrCa+ plasma ultracentrifugation step (which should not contain microvesicles); (ii) using microbeads conjugated to the supernatant from the BrCa– plasma ultracentrifugation step (which should not contain microvesicles); (iii) using microbeads conjugated to BrCa+ microvesicles. Negative selection rounds are performed between rounds of positive selection as described herein.

Microvesicles were isolated from plasma of a pool of 60 breast cancer patients (BrCa+). Microvesicles were also isolated from pool of 60 non-cancer samples (BrCa–). Microvesicles were isolated from the plasma using ultracentrifugation (120,000×g). Microvesicles were in the pellet from the ultracentrifugation. The supernatant from the ultracentrifugation was saved to use as a control. The microvesicles from both sample types were conjugated to MagPlex beads (Luminex Corp, Austin Tex.).

The aptamer library used consisted of a 2'F SUL1 RNA aptamer library. The sequence is 5'-GGGAGGAC-GAUGCGG-N40-CAGACGACUCGCUGAGGAUC-CGAGA-3' (SEQ ID NO. 8). The aptamer library consists of three sections: Forward primer—15 nucleotides, variable region—40 nucleotides; reverse primer—25 nucleotides. All pyrimidines (C and U) were 2'Fluoro modified.

The aptamer library was incubated with either the cancer or control microvesicle-conjugated beads. Nine rounds of positive selection for aptamers that bind the microvesicles were performed in parallel for both types of samples. Negative selection against beads conjugated to the input plasma supernatant after ultracentrifugation before positive selection in rounds 4-9. See Example 11 above for detailed protocol of the positive selection and negative selection steps.

The aptamers that were retained from the above positive selection were sequenced using Next Generation sequencing technology consisting of Ion Torrent NGS (Life Technologies, Inc., Carlsbad, Calif.). The MiSeq system may be used also (Illumina, Inc., San Diego, Calif.). The sequences are compared to identify aptamers that are found in the cancer samples and not the control samples, and vice versa. Such aptamers provide candidates that can be used to distinguish between BrCa and non-BrCa samples.

The sequencing data was analyzed according to the following procedure:

Step 1: Sequences were ranked according to frequencies in entire aptamer pool recovered in round 9 after negative selection against beads conjugated to microvesicle-depleted cancer plasma followed by positive selection against beads conjugated to cancer microvesicles.

Step 2: Fold changes were calculated between noted sample in Step 1 and: (i) same sample after additional negative selection against microvesicle depleted cancer plasma; (ii) same sample after additional negative selection against non-cancer microvesicles; (iii) same sample after additional negative selection against microvesicles depleted non-cancer plasma.

Step 3: Sequences were ranked based on fold changes calculated in Step 2 to identify sequences which are abundant or deficient in aptamer pool selected for breast cancer derived microvesicles.

Step 4: Possible mutant sequences (e.g., due to PCR or other errors) were removed based on results of consolidation analysis.

Step 5: Sequences were identified with fold changes greater than 3 and minimum frequency 50 in all three variants (i, ii and iii in step 2).

The same selection schemes as in steps 1-5 were performed for aptamers selected against beads conjugated to non-cancer microvesicles.

A number of representative sequences obtained from these procedures are shown in Table 11. The sequences in the table were identified in the aptamer pools from selection against BrCa microvesicles but were not in the aptamer pools selected against non-cancer samples. In Table 11, the sequences are shown 5' to 3' from left to right, wherein each complete sequence consists of a 5' leader sequence 5'-GGGAGGACGAUGCGG (SEQ ID NO. 9) followed by the indicated Variable Sequence followed by the 3' tail sequence 5'-CAGACGACUCGCUGAGGAUCCGAGA (SEQ ID NO. 10). Each sequence is derived from a library having a leader and tail (see description above) with a variable sequence between. It is understood that the nucleotide sequences that are disclosed in Table 11 can also be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to microvesicle antigens or functional fragments thereof.

TABLE 11

BrCa microvesicle aptamer candidate sequences

| ID (FIG.) | SEQ ID NO. | Variable Sequence |
|---|---|---|
| BCE8 (FIG. 10Ai) | 25 | UACCGCCUCAUCAUCGGACACGACGUGUAUCAGUUGGCUG |
| BCE9 (FIG. 10Aii) | 26 | GUUCUCGCCUCUGUCCUCAUGGUUCGAACCGGUAUGCAUG |
| BCE10 (FIG. 10Aiii) | 27 | GCGGUUUCUUCUCCUGACUACAUGAGAUUAAUAAACGCGC |
| BCE11 (FIG. 10Aiv) | 28 | CCGCCUCGAACACUGACGUCGUGGAACCUUCGAUUGCUAG |
| BCE12 (FIG. 10Av) | 29 | AAUCACAGUAAUUCUGCCCCUCUGAUGAAACCGGUUACUU |
| BCE13 (FIG. 10Avi) | 30 | CUUAGUGAUUCGCCGCCCCUCUGUUUAGUGGCCAUUGGA |
| BCE14 (FIG. 10Avii) | 31 | ACACUAUUCCGGUAAGUCAUCGUUUAACCGUUUGUUGCAA |
| BCE15 (FIG. 10Aviii) | 32 | UGCGCAACGCCUUGAUUCACUCCUACAGUGUGUCUAUAGA |
| BCE16 (FIG. 10Aix) | 33 | AAUGUUAAGCUUACAUACGCCUGGGUCACUCUUUGUUCUG |
| BCE17 (FIG. 10Bi) | 34 | GUAAAUAUUCACGUUGAAUCGCCUUGCUCCUCUUAGUCUG |
| BCE18 (FIG. 10Bii) | 35 | CCGCCUCGGAUCGUUCCCAAUGGUGGUACCCCUAUUAAUG |
| BCE19 (FIG. 10Biii) | 36 | UGUAGAUCGUUCUUAUCCGCCUCGGUCUUCCCCAGGUUAA |
| BCE20 (FIG. 10Biv) | 37 | AUCGUCGGGCCCCUUUUAUGAAACUUACAUGAAAGCGCAC |
| BCE21 (FIG. 10Bv) | 38 | UAAGAGUGCACAGUACUGCCUCGAUCCUCCAUGGCUUAAG |
| BCE22 (FIG. 10Bvi) | 39 | GAAUUAGUACUGACGGCCGCCUUGAUCCUCCGUUAGUCUG |
| BCE23 (FIG. 10Bvii) | 40 | GCCCGCCUCCGAAGCCCUCCUAAGUGCACUUUAAACCGCG |
| BCE24 (FIG. 10Bviii) | 41 | CCGCCUGGGAUCACUCUCUACGCGUAUAAAUGCUCUGUCA |

TABLE 11-continued

BrCa microvesicle aptamer candidate sequences

| ID (FIG.) | SEQ ID NO. | Variable Sequence |
|---|---|---|
| BCE25 (FIG. 10Bix) | 42 | AGUCUGACCCUGUUAUGGACUACCAUAUCAGAAAGGUACU |
| BCE26 (FIG. 10Ci) | 43 | GGUGAUCCUCCCCCCCGCCUCGAAGAUUUGUGCACAUAUC |
| BCE27 (FIG. 10Cii) | 44 | GCUACCAUCGUCUAGUGAGUCACCCUUAGUUCAUCAAGGC |

Each sequence in Table 11 is synthesized in two variants for further investigation: 5' biotinylated and 3' biotinylated. This provides aptamer variants that can be captured at the 5' end or the 3' end as desired. The aptamers are further synthesized with each pyrimidine (C and U) 2'Fluoro modified. The aptamers may also be synthesized as the DNA sequence corresponding to each RNA sequence in Table 11. The aptamer libraries can also be filtered based on predicted secondary sequence, free energy, and other parameters as described herein.

Figure 10A:
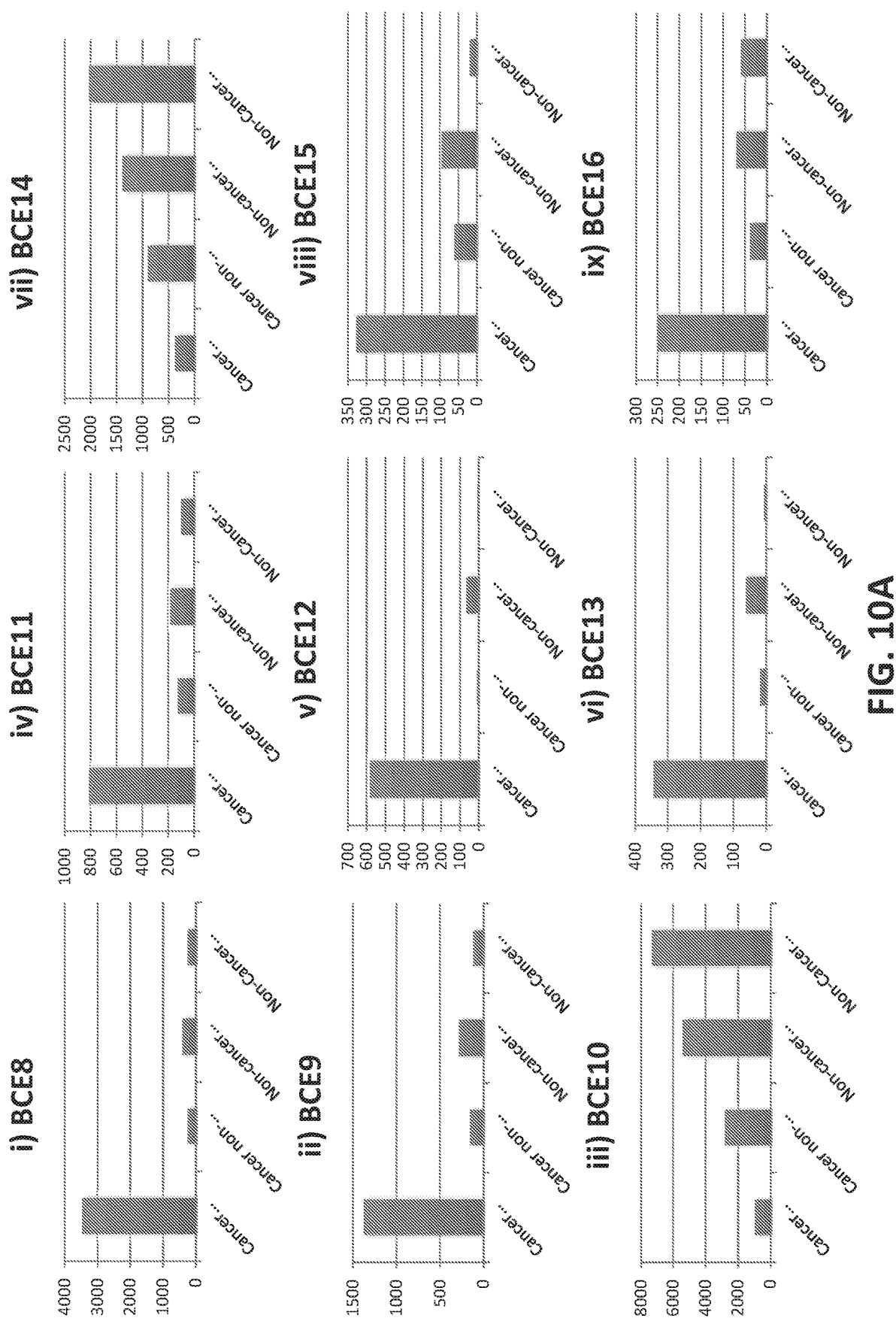
FIGS. 10A-10C illustrate binding of selected aptamers against microbeads conjugated to various input sample. The aptamers were selected from an aptamer library as binding to microbeads conjugated to breast cancer-derived microvesicles. Experimental details are in the Examples herein. Each plot shows a different aptamer. The Y-axis indicates level of binding. In each group of samples, binding of 9 purified aptamer candidates is shown. The input sample is indicated on the X axis from left to right as follows: 1) Cancer Exosome: aptamer binding to microbeads conjugated to microvesicles isolated from plasma samples from breast cancer patients; 2) Cancer Non-exosome: aptamer binding to microbeads conjugated to plasma samples from breast cancer patients after removal of microvesicles by ultracentrifugation; 3) Non-Cancer Exosome: aptamer binding to microbeads conjugated to microvesicles isolated from plasma samples from normal (i.e., non-breast cancer) patients; 4) Non-Cancer Non-Exosome: aptamer binding to microbeads conjugated to plasma samples from breast cancer patients after removal of microvesicles by ultracentrifugation.
Figure 10B:
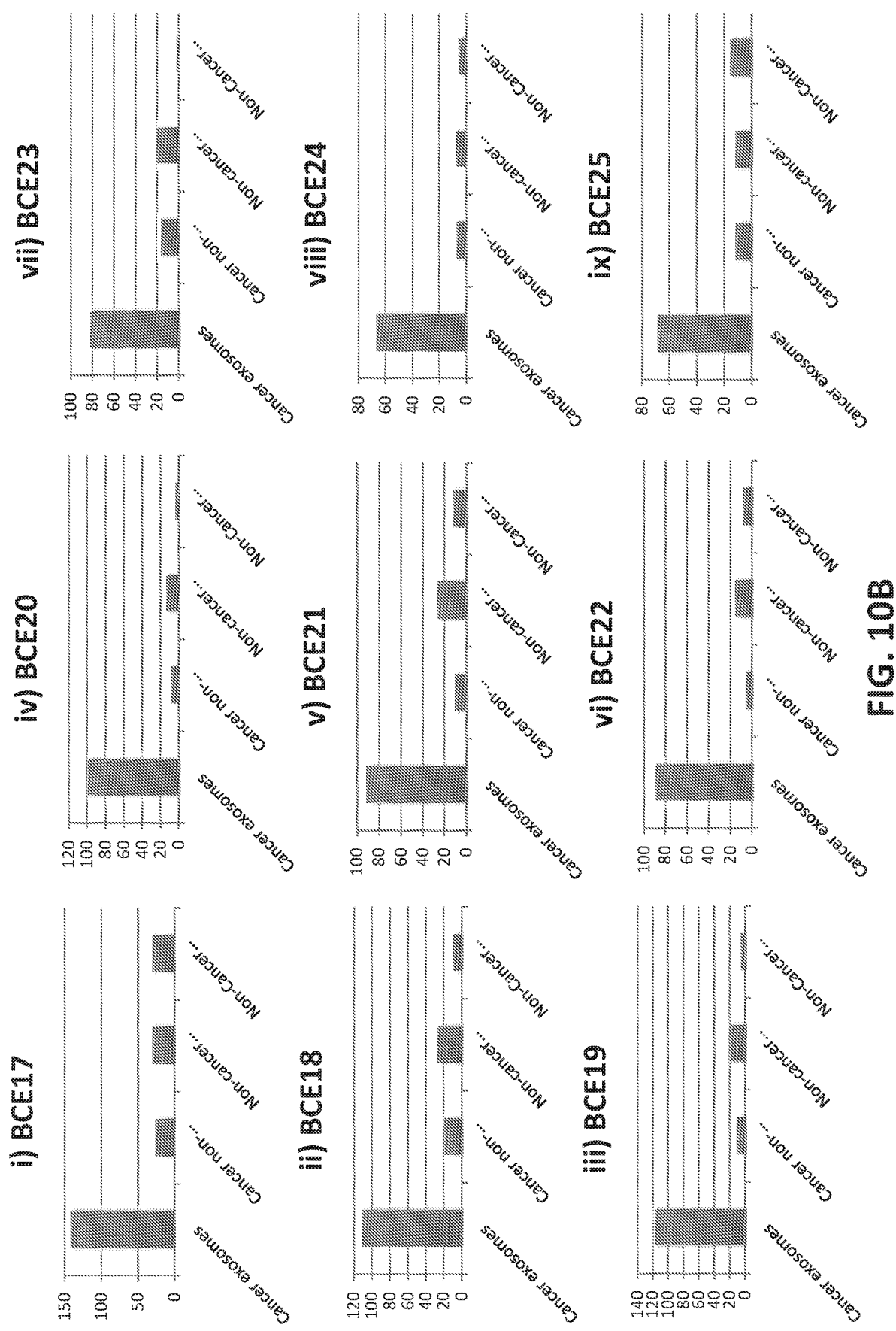
Figure 10C:
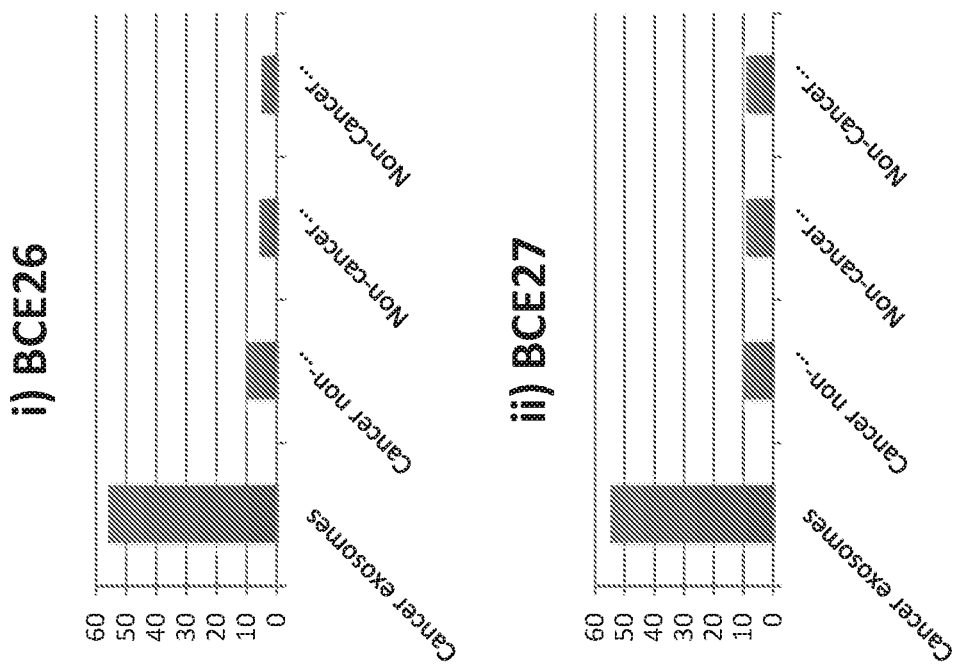

FIGS. 10A-C show binding of the aptamers in Table 11 against microbeads conjugated to various input samples. The aptamer is indicated above each plot and the plot for each aptamer is indicated in the ID column in Table 11. The input sample is indicated on the X axis from left to right as follows: 1) Cancer Exosome: aptamer binding to microbeads conjugated to microvesicles isolated from plasma samples from breast cancer patients; 2) Cancer Non-exosome: aptamer binding to microbeads conjugated to plasma samples from breast cancer patients after removal of microvesicles by ultracentrifugation; 3) Non-Cancer Exosome: aptamer binding to microbeads conjugated to microvesicles isolated from plasma samples from normal (i.e., non-breast cancer) patients; 4) Non-Cancer Non-Exosome: aptamer binding to microbeads conjugated to plasma samples from breast cancer patients after removal of microvesicles by ultracentrifugation. As shown in FIGS. 10A-C, the aptamers were each able to distinguish between the cancer microvesicle samples versus the supernatant control samples and the non-cancer microvesicles. Further, all sequences in Table 11 were observed as binding more abundantly to cancer derived microvesicles as compared to non-cancer derived microvesicles with the exception of BCE10 and BCE14, which were observed as binding more abundantly to non-cancer derived microvesicles as compared to cancer derived microvesicles.

Based on the comparisons performed in this Example, aptamers that bind different starting input are obtained, including: 1) aptamers that preferentially bind cancer-derived microvesicles over non-cancer derived microvesicles; 2) aptamers that preferentially bind non-cancer-derived microvesicles over cancer derived microvesicles; 3) aptamers that bind both non-cancer-derived microvesicles and cancer derived microvesicles (e.g., "universal" binders); and 4) aptamers that bind plasma components that have been depleted of microvesicles.

The aptamer libraries in this Example are further subjected to four rounds of additional negative and positive selection. The positive selection is performed as described in this Example. The negative selection rounds are performed using the beads conjugated to non-cancer microvesicles as negative selection for aptamers obtained by positive selection against beads conjugated to cancer microvesicles. Similarly, the negative selection rounds are performed using the beads conjugated to cancer microvesicles as negative selection for aptamers obtained by positive selection against beads conjugated to non-cancer microvesicles.

Example 13: Disease Diagnosis

This example illustrates the use of oligonucleotide probes of the present invention to diagnose a proliferative disease.

A suitable quantity of an oligonucleotide or pool of oligonucleotides that bind a BrCa-derived population of microvesicles, such as identified in Example 10 or Example 12 or various Examples below, is synthesized via chemical means known in the art. The oligonucleotides are conjugated to a diagnostic agent suitable for detection, such as a fluorescent moiety, using a conjugation method known in the art.

The composition is applied to microvesicles isolated from blood samples taken from a test cohort of patients suffering from a proliferative disease associated with the overexpression of microvesicles, e.g. breast cancer. The composition is likewise applied to microvesicles isolated from blood samples taken from a negative control cohort, not suffering from a proliferative disease.

The use of appropriate detection techniques (e.g., microbead assay or flow cytometry) on the test cohort samples indicates the presence of disease, while the same techniques applied to the control cohort samples indicate the absence of disease.

The results show that the oligonucleotides of the present invention are useful in diagnosing proliferative diseases.

Example 14: Theranostics

This example illustrates the use of oligonucleotide probes of the present invention to provide a theranosis for a drug for treating a proliferative disease.

A suitable quantity of an oligonucleotide or pool of oligonucleotides that bind a BrCa-derived population of microvesicles, such as identified in Example 10 or Example 12 or various Examples below, is synthesized via chemical means known in the art. The probes are conjugated to an agent suitable for detection, such as a fluorescent moiety, using a method known in the art such as conjugation. The oligonucleotide probe or panel of oligonucleotide probes are within a suitable composition, such as a buffered solution.

Treatment selection. The composition is applied to microvesicles isolated from blood samples taken from a test cohort of patients suffering from a proliferative disease, e.g.

breast cancer, that responded to a certain treatment, e.g., trautuzamab. The composition is likewise applied to microvesicles isolated from blood samples taken from a control cohort consisting of patients suffering from the same proliferative disease that did not respond to the treatment. The use of appropriate detection techniques (e.g., microbead assay or flow cytometry) on the test cohort samples indicates that probes which bind the samples are useful for identifying patients that will respond to the treatment, while the same techniques applied to the control cohort samples identifies probes useful for identifying patients that will not respond to the treatment.

Treatment monitoring. In another setting, the composition is applied to microvesicles isolated from blood samples taken from a test cohort of patients suffering from a proliferative disease, e.g. breast cancer, prior to or during a course of treatment, such as surgery, radiotherapy and/or chemotherapy. The composition is then applied to microvesicles isolated from blood samples taken from the patients over a time course. The use of appropriate detection techniques (e.g., microbead assay or flow cytometry) on the test cohort samples indicates whether the detected population of disease-related microvesicles increases, decreases, or remains steady in concentration over time during the course of treatment. An increase in the population of disease-related microvesicles post-treatment may indicate that the treatment is ineffective whereas a decrease in the population of disease-related microvesicles post-treatment may indicate that the treatment has a beneficial effect.

The results show that the oligonucleotide probes of the present invention are useful in theranosing proliferative diseases.

Example 15: Therapeutic Oligonucleotide Probes

This example illustrates the use of oligonucleotide probes of the present invention to treat a proliferative disease.

A suitable quantity of an oligonucleotide or pool of oligonucleotides that bind a BrCa-derived population of microvesicles, such as identified in Example 10 or Example 12 or various Examples below, is synthesized via chemical means known in the art. The oligonucleotides are conjugated to a chemotherapeutic agent, such as Doxil, using a conjugation method known in the art. The conjugate is formulated in an aqueous composition.

The composition is administered intravenously, in one or more doses, to a test cohort of mice suffering from a proliferative disease associated with the overexpression of the microvesicles, e.g. a breast cancer model. A control cohort, not suffering from a proliferative disease is administered the identical composition intravenously, according to a corresponding dosage regimen.

Pathological analysis of tumor samples and/or mouse survival indicates that mortality and/or morbidity are improved in the test cohort over the control cohort.

The results show that the oligonucleotides of the present invention are useful in treating proliferative diseases.

Useful oligonucleotides can be used to treat proliferative diseases in other organisms, e.g., a human.

Example 16: Oligonucleotide—Sequencing Detection Method

This example illustrates the use of an oligonucleotide pool to detect microvesicles that are indicative of a phenotype of interest. The method makes use of a pool of oligonucleotides that have been enriched against a target of interest that is indicative of a phenotype of interest. The method in this Example allows efficient use of a library of oligonucleotides to preferentially recognize a target entity.

For purposes of illustration, the method is described in the Example with a microvesicle target from a bodily fluid sample. One of skill will appreciate that the method can be extended to other types of target entity (e.g., cells, proteins, various other biological complexes), sample (e.g., tissue, cell culture, biopsy, other bodily fluids) and other phenotypes (other cancers, other diseases, etc) by enriching an aptamer library against the desired input samples.

General Workflow:

1) Obtain sample (plasma, serum, urine or any other biological sample) of patients with unknown medical etymology and pre-treating them accordingly to ensure availability of the target of interest (see below). Where the target of interest is a microvesicle population, the microvesicles can be isolated and optionally tethered to a solid support such as a microbead.

2) Expose pre-treated sample to an oligonucleotide pool carrying certain specificity against target of interest. As described herein, an oligonucleotide pool carrying certain specificity against the target of interest can be enriched using various selection schemes, e.g., using non-cancer microvesicles for negative selection and cancer microvesicles for positive selection as described above. DNA or RNA oligonucleotides can be used as desired.

3) Contact oligonucleotide library with the sample.

4) Elute any oligonucleotides bound to the target.

5) Sequence the eluted oligonucleotides. Next generation sequencing methods can be used.

6) Analyze oligonucleotide profile from the sequencing. A profile of oligonucleotides known to bind the target of interest indicates the presence of the target within the input sample. The profile can be used to characterize the sample, e.g., as cancer or non-cancer.

Protocol variations:

Various configurations of the assay can be performed. Four exemplary protocols are presented for the purposes of the oligonucleotide-sequencing assay. Samples can be any appropriate biological sample. The protocols can be modified as desired. For example, the microvesicles can be isolated using alternate techniques instead or or in addition to ultracentrifugation. Such techniques can be disclosed herein, e.g., polymer precipitation (e.g., PEG), column chromatography, and/or affinity isolation.

Protocol 1:

Ultracentrifugation of 1-5 ml bodily fluid samples (e.g., plasma/serum/urine) (120K×g, no sucrose) with two washes of the precipitate to isolate microvesicles.

Measure total protein concentration of recovered sample containing the isolated microvesicles.

Conjugate the isolated microvesicles to magnetic beads (for example MagPlex beads (Luminex Corp. Austin Tex.)).

Incubate conjugated microvesicles with oligonucleotide pool of interest.

Wash unbound oligonucleotides by retaining beads using magnet.

Elute oligonucleotides bound to the microvesicles.

Amplify and purify the eluted oligonucleotides.

Oligonucleotide sequencing (for example, Next generation methods; Ion Torrent: fusion PCR, emulsion PCR, sequencing).

Assess oligonucleotide profile.

Protocol 2:

This alternate protocol does not include a microvesicle isolation step, microvesicles conjugation to the beads, or separate partitioning step. This may present non-specific binding of the oligonucleotides against the input sample.

Remove cells/debris from bodily fluid sample and dilute sample with PBS containing $MgCl_2$ (2 mM).

Pre-mix sample prepared above with oligonucleotide library.

Ultracentrifugation of oligonucleotide/sample mixture (120K×g, no sucrose). Wash precipitated microvesicles.

Recover precipitate and elute oligonucleotides bound to microvesicles.

Amplify and purify the eluted oligonucleotides.

Oligonucleotide sequencing (for example, Next generation methods; Ion Torrent: fusion PCR, emulsion PCR, sequencing).

Assess oligonucleotide profile.

Protocol 3:

This protocol uses filtration instead of ultracentrifugation and should require less time and sample volume.

Remove cells/debris from bodily fluid sample and dilute it with PBS containing $MgCl_2$ (2 mM).

Pre-mix sample prepared above with oligonucleotide library.

Load sample into filter (i.e., 150K or 300K MWCO filter or any other that can eliminate unbound or unwanted oligonucleotides). Centrifuge sample to concentrate. Concentrated sample should contain microvesicles.

Wash concentrate. Variant 1: Dilute concentrate with buffer specified above to the original volume and repeat centrifugation. Variant 2: Dilute concentrate with buffer specified above to the original volume and transfer concentrate to new filter unit and centrifuge. Repeat twice.

Recover concentrate and elute oligonucleotides bound to microvesicles.

Amplify and purify the eluted oligonucleotides.

Oligonucleotide sequencing (for example, Next generation methods; Ion Torrent: fusion PCR, emulsion PCR, sequencing).

Assess oligonucleotide profile.

Protocol 4:

Ultracentrifugation of 1-5 ml bodily fluid sample (120K×g, no sucrose) with 2 washes of the precipitate to isolate microvesicles.

Pre-mix microvesicles with oligonucleotide pool.

Load sample into 300K MWCO filter unite and centrifuge (2000×g). Concentration rate is ~3×.

Wash concentrate. Variant 1: Dilute concentrate with buffer specified above to the original volume and centrifuge. Repeat twice. Variant 2: Dilute concentrate with buffer specified above to the original volume and transfer concentrate to new filter unit and centrifuge. Repeat twice Recover concentrate and elute oligonucleotides bound to microvesicles.

Amplify and purify the eluted oligonucleotides.

Oligonucleotide sequencing (for example, Next generation methods; Ion Torrent: fusion PCR, emulsion PCR, sequencing).

Assess oligonucleotide profile.

In alterations of the above protocols, polymer precipitation is used to isolate microvesicles from the patient samples. For example, the oligonucleotides are added to the sample and then PEG4000 or PEG8000 at 4% or 8% concentration is used to precipitate and thereby isolate microvesicles. Elution, recovery and sequence analysis continues as above.

Example 17: Plasma/Serum Probing with an Oligonucleotide Probe Library

The following protocol is used to probe a plasma or serum sample using an oligonucleotide probe library.

Input Oligonucleotide Library:

Use 2 ng input of oligonucleotide library per sample.

Input oligonucleotide library is a mixture of two libraries, cancer and non-cancer enriched, concentration is 16.3 ng/ul.

Dilute to 0.2 ng/ul working stock using Aptamer Buffer (3 mM $MgCl_2$ in 1×PBS)

Add 10 µl from working stock (equal to 2 ng library) to each optiseal tube

Materials:

PBS, Hyclone SH30256.01, LN: AYG165629, bottle #8237, exp. 7/2015

Round Bottom Centrifuge Tubes, Beckman 326820, LN:P91207

OptiSeal Centrifuge tubes and plugs, polyallomer Konical, Beckman 361621, lot #Z10804SCA Ultracentrifuge rotor: 50.4 TI Ultracentrifuge rotor: 50.4 TI, Beckman Cans ID #0478

Protocol:

1 Pre-chill tabletop centrifuge, ultracentrifuge, buckets, and rotor at 4° C.

2 Thaw plasma or serum samples

3 Dilute 1 ml of samples with 1:2 with Aptamer Buffer (3 mM $MgCl_2$ in 1×PBS)

4 Spin at 2000×g, 30 min, 4° C. to remove debris (tabletop centrifuge)

5 Transfer supernatants for all samples to a round bottom conical

6 Spin at 12,000×g, 45 min, 4° C. in ultracentrifuge to remove additional debris.

7 Transfer supernatant about 1.8 ml for all samples into new OptiSeal bell top tubes (uniquely marked).

8 Add 2 ng (in 10 ul) of DNA Probing library to each optiseal tube

9 QS to 4.5 ml with Aptamer Buffer

10 Fix caps onto the OptiSeal bell top tubes

11 Apply Parafilm around caps to prevent leakage

12 Incubate plasma and oligonucleotide probe library for 1 hour at room temperature with rotation 13 Remove parafilm (but not caps)

14 Place correct spacer on top of each plugged tube

15 Mark pellet area on the tubes, insure this marking is facing outwards from center.

16 Spin tubes at 120,000×g, 2 hr, 4° C. (inner row, 33,400 rpm) to pellet microvesicles.

17 Check marking is still pointed away from center.

18 Completely remove supernatant from pellet, by collecting liquid from opposite side of pellet marker and using a 10 ml syringe barrel and 21G2 needle 19 Discard supernatant in appropriate biohazard waste container 20 Add 1 ml of 3 mM MgCl2 diluted with 1×PBS 21 Gentle vortex, 1600 rpm for 5 sec and incubate 5 min at RT.

22 QS to ~4.5 mL with 3 mM Mg Cl2 diluted with 1×PBS

23 Fix caps onto the OptiSeal bell top tubes.

24 Place correct spacer on top of each plugged tube.

25 Mark pellet area on the tubes, insure this marking is facing outwards from center.

26 Spin tubes at 120,000×g, 70 min, 4° C. (inner row 33,400 rpm) to pellet microvesicles 27 Check marking in still pointed away from center.

28 Completely remove supernatant from pellet, by collecting liquid from opposite side of pellet marker and using a 10 ml syringe barrel and 21G2 needle 29 Discard supernatant in appropriate biohazard waste container 30 Add 1 ml of 3 mM MgCl2 diluted with 1×PBS 31 Gentle vortex, 1600 rpm for 5 sec and incubate 5 min at RT.

32 QS to ~4.5 mL with 3 mM Mg Cl2 diluted with 1×PBS

33 Fix caps onto the OptiSeal bell top tubes.

34 Place correct spacer on top of each plugged tube.

35 Mark pellet area on the tubes, insure this marking is facing outwards from center.

36 Spin tubes at 120,000×g, 70 min, 4° C. (inner row 33,400 rpm) to pellet microvesicles 37 Check marking is still pointed away from center.

38 Save an aliquot of the supernatant (100 ul into a 1.5 ml tube)

39 Completely remove supernatant from pellet, by collecting liquid from opposite side of pellet marker and using a 10 ml syringe barrel and 21G2 needle 40 Add 50 ul of Rnase-free water to the side of the pellet 41 Leave for 15 min incubation on bench top 42 Cut top off tubes using clean scissors.

43 Resuspend pellet, pipette up and down on the pellet side

44 Measure the volume, make a note on the volume in order to normalize all samples 45 Transfer the measured resuspended eluted microvesicles with bound oligonucleotides to a Rnase free 1.5 ml Eppendorf tube 46 Normalize all samples to 100 ul to keep it even across samples and between experiments.

Next Generation Sequencing Sample Preparation:

I) Use 50 ul of sample from above, resuspended in 100 ul H2O and containing microvesicle/oligo complexes, as template in Transposon PCR, 14 cycles.

II) AMPure transposon PCR product, use entire recovery for indexing PCR, 10 cycles.

III) Check indexing PCR product on gel, proceed with AMPure if band is visible. Add 3 cylces if band is invisible, check on gel. After purification quantify product with QuBit and proceed with denaturing and dilting for loading on HiSeq flow cell (Illumina Inc., San Diego, Calif.).

IV) 5 samples will be multiplexed per one flow cell. 10 samples per HiSeq.

Example 18: Enrichment of Oligonucleotides to Breast Cancer (BrCa) and Non-BrCa Derived Microvesicles In this Example, a naive oligonucleotide probe library is screened to enrich oligonucleotides that identify microvesicles circulating in the blood of breast cancer patients and microvesicles circulating in the blood of healthy, control individuals (i.e., without breast cancer). The procedure in this Example used the 9-round selection scheme shown in FIG. 11A.

Figure 11A:
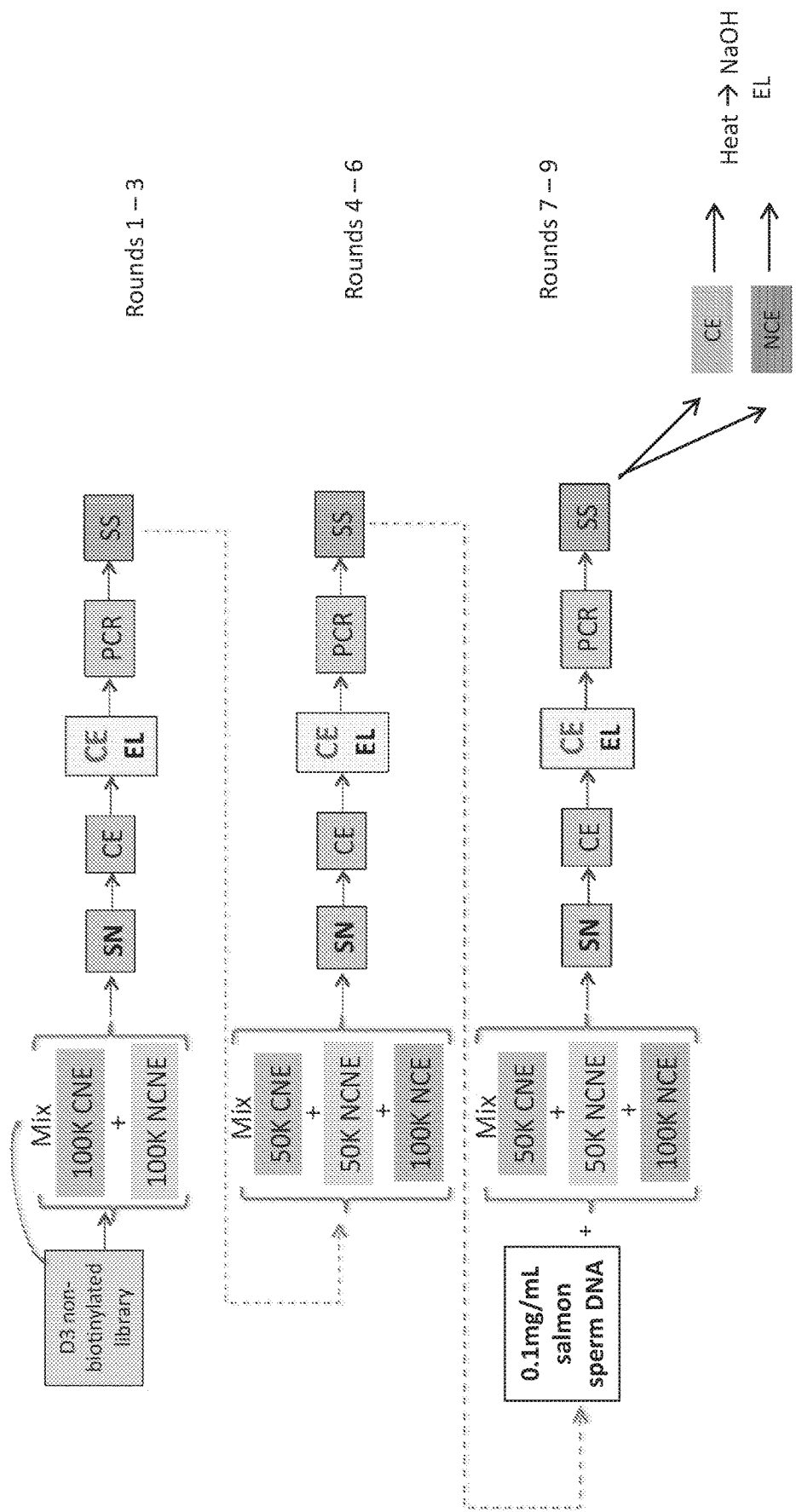
FIGS. 11A-11B illustrate enriching a naïve aptamer library for aptamers that differentiate between breast cancer and non-cancer microvesicles in plasma samples.
Figure 11B:
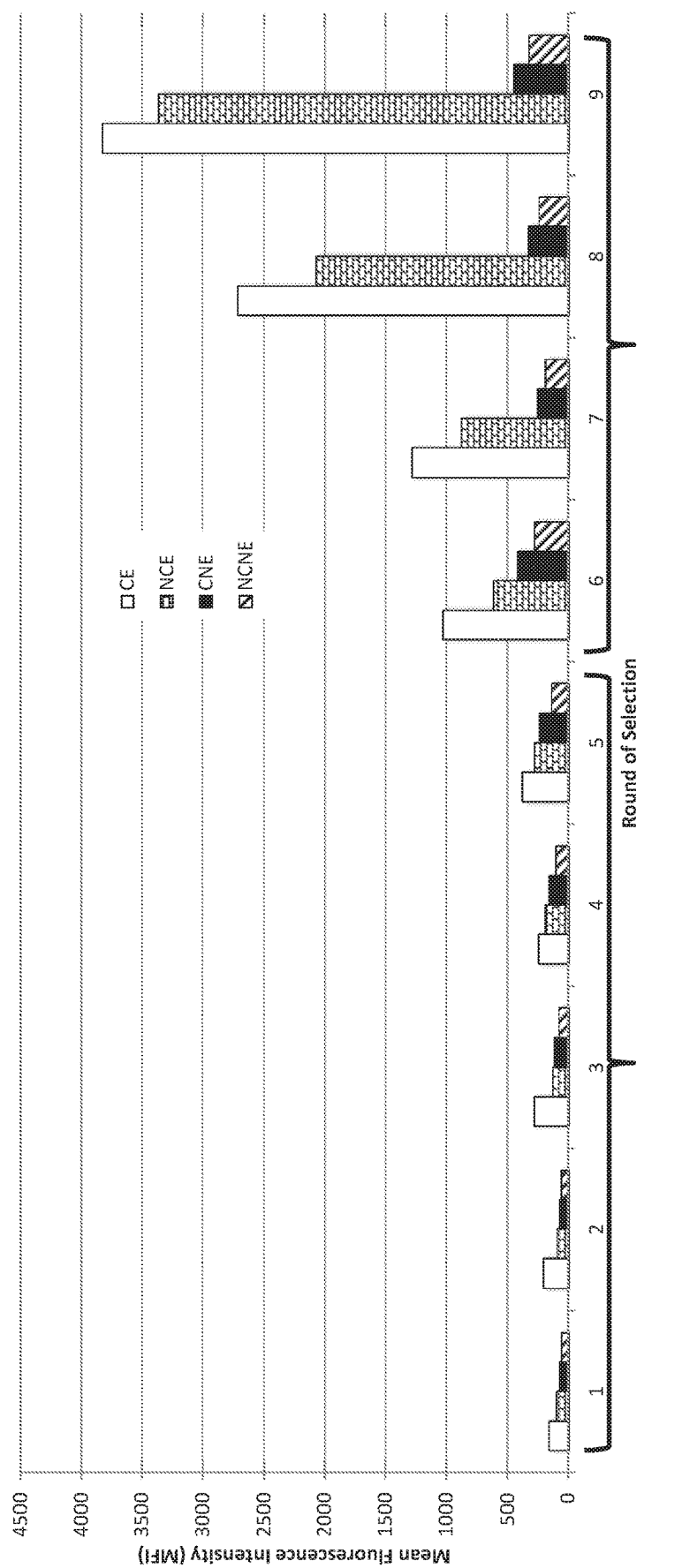

In FIGS. 11A-11B, the following abbreviations are used: CE—Cancer exosome samples; NCE—Non-cancer exosome samples; CNE—Cancer no exosome samples; NCNE—Non-cancer no exosome samples; MFI—Median Fluorescence Intensity; GC—GC content group analysis; Heat—heat elution; NaOH—sodium hydroxide elution. The terms exosome and microvesicle are used interchangeably.

As indicated in FIG. 11A, 0.1 mg/mL salmon sperm DNA was added as a competitor in selection rounds 7-9. FIG. 11B shows the enrichment of aptamers that bind to microvesicles (CE and NCE). Binding was determined by fluorescently labeling aptamer candidates and detecting binding to bead-capture microvesicles using a microbead assay format. At the end of round 9, only aptamers having GC content between ~30% and 70% were selected to generate panels to differentiate cancer and non-cancer samples. In addition, several groups of aptamers were selected using the following criteria: 1) 12 most commonly observed; 2) 12 most commonly observed having >2-fold change in binding observed between cancer and normal samples; 3) 30 most commonly observed having >2-fold change in binding observed between cancer and normal samples, >10 read counts in the library determined by high throughput sequencing, heat elution after selection round 9; and 4) 30 most commonly observed having >2-fold change in binding observed between cancer and normal samples, >10 read counts in the library determined by high throughput sequencing, NaOH elution after selection round 9.

Retained sequences are shown in Table 12 with selection criteria 1-4 indicated. In Table 12, the sequences are shown 5' to 3' from left to right, wherein each complete sequence consists of a 5' leader sequence 5'-GCTGTGTGACTCCT-GCAA (SEQ ID NO. 45) followed by the indicated Variable Sequence followed by the 3' tail sequence 5'-GCAGCTG-TATCTTGTCTCC (SEQ ID NO. 46).

TABLE 12

BrCa microvesicle oligonucleotide sequences

| SEQ ID NO. | Selection Criteria | Variable Sequence |
|---|---|---|
| 47 | 3 | GTCCGCTTGGGGGTGGGTATCGAAAATTCGCGTTCTGGGGCGG |
| 48 | 3 | CTTCGCTCGTTTCAATGTTCAGTTCTGGTCTTTAGGTCTTTAG |
| 49 | 3 | TAGGAGGATAATATGTATCCGGTGCATCGGCCTGACTTTCCCC |
| 50 | 3 | TAGGAGGGCTGAAAACTTGCTTCTTCCCGGTGCAGTTATAACA |
| 51 | 3 | TAGGAGGATAATATGTATCCGATGCATGGGCCCGACTTTCCCC |
| 52 | 3 | TGCGTTTTCCTTGGGGTTCAGGGTAGGATGGGGGTGGAGGTGG |
| 53 | 3 | GGGGGGCGGGTGGGCTGGTAAAAGGTGATGCGGGGGTATTGTT |
| 54 | 3 | TAGGAGGATAATATGTATCCGGTGCATCGGCCCAACTTTCCCC |
| 55 | 3 | CCAATCTCGGAAGGTTTAAATAAGGTGGTCTTTAGGTCTTTAG |

TABLE 12-continued

BrCa microvesicle oligonucleotide sequences

| SEQ ID NO. | Selection Criteria | Variable Sequence |
|---|---|---|
| 56 | 3 | TACGTTAAGTGGGTCGGGAGGGGGAATAGGGGGTTTGGTTGG |
| 57 | 3 | GTGAGGTCGGTGGGGCGGGGGATGGTGGGGGGTCGTTTACATT |
| 58 | 3 | CGATATTGGGGGGGGGTTGGCGGGCTATTTTCCGGGTGGGTG |
| 59 | 3 | TCGGTTCCTGTTAATTCGCTGGTGGTTGGTGGGGTGGCGGATG |
| 60 | 3 | GCGGGGAGGTGGGGGTGGGTGGAGGGTTGGTTACTCTCTACT |
| 61 | 3 | CGGGAATGGGAGGGTGGGGGTGGTGGCCGGGTCGTGTTATACC |
| 62 | 3 | TAGGAGGATAATATGTATCCGGTGCATCGGTCCGACTTTCCCC |
| 63 | 3 | TATAGTTGGGCGTAGGCGGGGGGGGTGGTTGGGAGGTCCAAG |
| 64 | 3 | TAGGAGGATAATATGTATCCGGTGCATCGGCCCGACCTTCCCC |
| 65 | 3 | TCGATCGTCCTCAGGATCTCGTGGTTCAAATCATAAAGATTAT |
| 66 | 3 | TGCTGTCTGGGCGGGGCGGTCTTGTGGTTTCTTTGGGGGGGG |
| 67 | 3 | GCGAGACAGGAGGGTGGTCTTATACGTGGGGGGGGGTGGTTGG |
| 68 | 3 | TAGGAGGGCTGAAGACTTGCTTCTTCCCGGTGCAGTTATAACA |
| 69 | 3 | CGTGTGGGGGGTGGGTTGGGCTCGGGTTGTTATCAGTTCCATG |
| 70 | 3 | CGATATTGGGGGGGGGGTTGGCGGGCTATTTTCCGGGTGGGTG |
| 71 | 3 | TAGGAGGATAATATGTATCCGGTGCATCGGCCCGACTTTCCTC |
| 72 | 3 | TAGGAGGATAATATGTATCCGGTGCATCGGCTCGACTTTCCCC |
| 73 | 3 | CTTCGCTCGTTTCAATGTTTAGTTCTGGTCTTTAGGTCTTTAG |
| 74 | 3 | GGACATGGGTTGGGTCGGGAGGGGTGGTCGGTTGGGCAGTAA |
| 75 | 3 | TAGGAGGATAATATGTATACGATGCATCGGCCCGACTTTCCCC |
| 76 | 3 | TAGGAGGATAATATGTATCAGATGCATCGGCCCGACTTTCCCC |
| 77 | 4 | TGGATGTATGGGGTCTCGGGGTGGGAGGGTTCAACTTATCTGG |
| 78 | 4 | GTCCGCTTGGGGGTGGGTATCGAAAATTCGCGTTCTGGGCGG |
| 79 | 4 | TCTTGTACAAATAGGAGGGAAGGGGGTTTTGGGAGGTGGGTGG |
| 80 | 4 | CTTCGCTCGTTTCAATGTTCAGTTCTGGTCTTTAGGTCTTTAG |
| 81 | 4 | CTGATGTTAGTAGGTCGGGGTCCGGTTGGGGGTTGGGTTGAGG |
| 82 | 4 | TGGCTCGTGGACGTGGTGGTGGCGGGTCGTGGGGGTGGGTAGG |
| 83 | 4 | TAGGAGGATAATATGTATCCGGATGCATCGGCACGACTTTCCCC |
| 84 | 4 | CGGGGAGGGGGGGTCGGGGTATTTATTGTGTATGTTTTTTGTG |
| 85 | 4 | TGACTGTATCTTGGGGCGGGTTCTGGGGGGGGTGTATTGTTCA |
| 86 | 4 | TAGGAGGATAATATGTATCCGATGCATCGGCCCGACTTTCACC |
| 87 | 4 | TCATGTCTAGGGGGGGAAGTCGGTTTGGGTGGGTACTCTGTG |
| 88 | 4 | CTTGTTTCGCTTTGGGTTTGGGCGGGTGGGTCAATTCCTGTTG |
| 89 | 4 | GGTGGGGGCCCTCGGTACTGTGGCGGGGTGGGTGGGTTTAGTG |
| 90 | 4 | TGCGTTTTCCTTGGGGTTCAGGGTAGGATGGGGGTGGAGGTGG |
| 91 | 4 | TGGTGGGGTGGGTCTGTGGGGTGGTTTTGTTCTTATCGGGGTT |
| 92 | 4 | TGGGTGGGTTACGGGTGGGTGTTGTTATCGCGCTGATCTGGTT |
| 93 | 4 | CGTGACGGTTTTAATCAGGGGGGGGACTCTAACATTTGGGTGG |

TABLE 12-continued

BrCa microvesicle oligonucleotide sequences

| SEQ ID NO. | Selection Criteria | Variable Sequence |
|---|---|---|
| 94 | 4 | TGCTCATATCGTGGGGGGATGGGGTTGCTAGTGGATGGGGTGG |
| 95 | 4 | GGGGGGCGGGTGGGCTGGTAAAAGGTGATGCGGGGGTATTGTT |
| 96 | 4 | TGATGTGGGGGGTGGGGTATAATACTTATGTTTGGGGTTTGGG |
| 97 | 4 | TTGGGTGGGTGGGAATGGGTATTTTTTCTTCGGGCGATGTTTG |
| 98 | 4 | TAGTTGGATACTGGATTTGGGAGGGATGGGGGGAGGAGGGTGG |
| 99 | 4 | CTGGAAGGTTGGGTGTGGGCGGGGGGGAGGTCTCTCTATGT |
| 100 | 4 | TACGTTAAGTGGGTCGGGAGGGGGGAATAGGGGGTTTGGTTGG |
| 101 | 4 | TGCCGTGGGCCGGGGAGGGTGGGTTGGCGTCTCTGTTTCGATA |
| 102 | 4 | GGGGGGGCGGCCGGGGTGGACTGTGGCCCGTCTTCGTATTGTT |
| 103 | 4 | TGGTGGTGGCTGGGGGACGGGTATCCTGGAATTAGGGGTGGG |
| 104 | 4 | TCGGTTCATGTTGGGTGGGATCGGGGCGGGGTTTCTTCTCCTG |
| 105 | 4 | TAGGAGGATAATATGTATACGATGCATCGGCCCGACTTTCCCC |
| 106 | 4 | TCGTGGGTGTGTTCTGGGGGGCGTGGACGGGGGTTAATGGGCA |
| 107 | 1 | TAGGAGGATAATATGTATCCGATGCATCGGCCCGACTTTCCCC |
| 108 | 1 | TAAGAGTCTTAGGATGACGTCATTCGTCCGTCACGGTGCGGGA |
| 109 | 1 | GCCTGGCCAGATAGCAGTTACCTTACGGGATCTATATTCACCG |
| 110 | 1 | TGGCTCGTGGACGTGGTGGTGGCGGGTCGTGGGGGTGGGTAGG |
| 111 | 1 | TTCGTGTTCATCTGTTTATTGTTATTCACAATCCGTCTTTTGT |
| 112 | 1 | CGAATCCGTCGACCGCCCTCGTAACCATCCAACCCAGTCTCCT |
| 113 | 1 | CAGGAAAGTTACTTATCTTTTAGACGGTTATGTTCTCATTACT |
| 114 | 1 | ATCTGCTCGATACGTAGATAGTCTGCTCGATACAAAAGGGTGG |
| 115 | 1 | CGATGAGCGGGCTCCGATATTGTGTCGGCGTGACTACCTTGAT |
| 116 | 1 | GGTCGGCCTATTTATTGCGGCACGTTGTTTCTTGATGTCGCCC |
| 117 | 1 | TCGAATTCAGTTCTACATGTGTATTTCTTGCTCCGTTTCAGAA |
| 118 | 1 | TCGGTCCGGCAACAAACCCCACGCGCCTTCGATATGCCTGTCG |
| 119 | 2 | CCAATCTCGGAAGGTTTAAATAAGGTGGTCTTTAGGTCTTTAG |
| 120 | 2 | CGATATTGGGGGGGGGTTGGCGGGCTATTTTCCGGGTGGGTG |
| 121 | 2 | CGGGAATGGGAGGGTGGGGGTGGTGGCCGGGTCGTGTTATACC |
| 122 | 2 | CGTGGTGGGTTCTTGGGTGGGGGGGAGGGTTGGCGTAGTATA |
| 123 | 2 | GTGAGGTCGGTGGGGCGGGGATGGTGGGGGGTCGTTTACATT |
| 124 | 2 | TACGTTAAGTGGGTCGGGAGGGGGAATAGGGGGTTTGGTTGG |
| 125 | 2 | TAGGAGGATAATATGTATCCGGTGCATCGGCCCAACTTTCCCC |
| 126 | 2 | TAGGAGGGCTGAAAACTTGCTTCTTCCCGGTGCAGTTATAACA |
| 127 | 2 | TCGGTTCCTGTTAATTCGCTGGTGGTTGGTGGGGTGGCGGATG |
| 128 | 2 | TGCTGTCTGGGCGGGGCGGTCTTGTGGTTTCTTTGGGGGGGG |
| 129 | 2 | AACATGGGGTTCTGATAAACCTGTGCCAAATACATTGTTGAGT |
| 130 | 2 | ATTCCTCCTTTGTAAGGGATGATATCCAACTCCTCTGCGTTCG |

Individual aptamer candidates in Table 12 are synthesized. The aptamers are labeled with a fluorescent label and used to detect binding to bead-capture microvesicles using a microbead assay format. The microbead results are used to identify aptamers and panels of aptamers that differentiate cancer and non-cancer plasma samples.

Example 19: Aptamer Based Precipitation of Microvesicles in Plasma

Aptamers can specifically recognize target proteins with nanomolar affinity and have some potential advantages compared to antibodies due to their chemical stability, ease of synthesis and overall reproducibility. Microvesicles were isolated from a rat glioma cell line model that expresses or does not express the human EGFR protein in order to optimize aptamer-microvesicle complex formation and isolation in plasma. Microvesicles spiked into human plasma were precipitated with the positive EGFR DNA or RNA aptamer but not with a reverse complement control sequence. There was no observed binding of the positive or negative aptamer to microvesicles that do not express EGFR. Binding of aptamers to microvesicles was confirmed with aptamer based ELISAs, EMSA assays, and flow cytometry. These results demonstrate aptamer-based precipitation of microvesicles from a complex biological sample.

Example 20: Quantitative Proteomics of EGFR, EGFRviii, and EGFR Negative Microvesicles from a Rat Glioma Cell Line In this Example, we performed quantitative proteomics on microvesicles isolated from a rat glioma cell line F98 (parental line), F98(EGFR) and F98(EGFRviii). Different lots of microvesicles purified from each cell line type were considered biological replicates and each biological replicate was analyzed in four technical replicates by tandem mass tag 6-plex (TMT) peptide labeling and LC-MS/MS. The general microvesicle markers CD81, CD9, CD63, Tsg101, and Alix were identified in all technical replicates. Multiple proteins were found to be up or down-regulated including a 7.5-fold increase in EGFR and a 2.6-fold increase in the EGFR binding partner HMCN2 in the F98 [EGFR] compared with the parental line. These results indicate that expression of a single biomarker may affect global proteomic changes in microvesicles.

Example 21: Oligonucleotide Probe Library

This Example presents further development of the oligonucleotide probe library to detect biological entities such as described in Example 18 above. In this Example, steps were taken to reduce the presence of double stranded oligonucleotides (dsDNA) when probing the patient samples. The data were also generated comparing the effects of 8% and 6% PEG used to precipitate microvesicles (and potentially other biological entities) from the patient samples.

Protocol:

1) Pre-chill tabletop centrifuge at 4° C.

2) Protease inhibition: dissolve 2 tablets of "cOmplete ULTRA MINI EDTA-free EASYpack" protease inhibitor in 1100 ul of $H_2O$ (20× stock of protease inhibitor).

3) Add 50 ul of protease inhibitor to the sample (on top of frozen plasma) and start thawing: 1 ml total ea.

4) To remove cells/debris, spin samples at 10,000×g, 20 min, 4° C. Collect 1 ml supernatant (SN).

5) Mix 1 ml supernatant from step 4 with 1 ml of 2×PBS 6 mM $MgCl_3$, collect 400 ul into 3 tubes (replicates A, B, C) and use it in step 6.

6) Add competitor per Table 13: make dilutions in 1×PBS, 3 mM $MgCl_2$, mix well, pour into trough, pipet using multichannel

TABLE 13

| | | | Competitors | | | | |
|---|---|---|---|---|---|---|---|
| units | Type of Competitor | Stock Concentration | Intermediate stock concentration | Number of samples | Volume from stock to make intermediate stock, ul | Buffer to make intermediate stock | Final Volume, ul | Final Concentration |
| ng/ul | Salmon DNA | — | 40 | — | — | — | 425.5 | 0.8 |
| ng/ul | tRNA | — | 40 | — | — | — | 425.5 | 0.8 |
| x | S1 | 20 | 0.5 | 280 | 65.5 | 2555.6 | 425.5 | 0.01 |

7) Incubate for 10 min, RT, end-over-end rotation

Pool of 6-3S and 8-3S oligonucleotide probing libraries is ready: 2.76 ng/ul (~185 ng). Save pool stock and dilutions. New pool can be made by mixing 171.2 ul (500 ng) of library 6-3S (2.92 ng/ul) with 190.8 ul (500 ng) of library 8-3S (2.62 ng/ul). Aliquot pooled library into 30 ul and store at −80 C.

Add ssDNA oligonucleotide probing library to the final concentration 2.5 pg/ul for binding. Make dilutions in 1×PBS, 3 mM $MgCl_2$.

TABLE 14

| | | | Probe library calculations | | | | | |
|---|---|---|---|---|---|---|---|---|
| Original stock, ng/ul | Lib Name | Required working stock (ng/ul) | ul from original stock to make working | ul of buffer to make working | Final volume, ul | Number of samples | Volume per sample from working stock | Final concentration (pg/ul) |
| 2.76 | Pooled library 6-3S/8-3S | 0.1 | 26.1 | 694.1 | 720.2 | 60 | 10.9 | 2.5 |

8) Binding: Incubate for 1 h at RT with rotation.

9) Prepare polymer solution: 20% PEG8000 in 1×PBS 3 mM MgCl2 (dilute 40% PEG8000 with 2×PBS with 6 mM MgCl2). Add 20% PEG8000 to sample to the final concentration 6%. Invert few times to mix, incubate for 15 min at 4C

TABLE 15

| | | | PEG calculations | | | | |
|---|---|---|---|---|---|---|---|
| PEG MW | PEG stock, % | Final conc., % | Final volume, ul | Volume 20% PEG to add, ul | Volume of buffer to adjust final volume, ul | Sample volume before adding PEG | Total samples | Total 20% PEG needed, ml |
| 8000 | 20 | 6 | 622.8 | 186.9 | −0.4 | 436.4 | 60 | 11.2 |

10) Spin at 10,000×g for 5 min, RT.

11) Remove SN, add 1 ml 1×PBS, 3 mM MgCl2 and wash pellet by gentle inversion with 1 ml aptamer buffer.

12) Remove buffer, Re-suspend pellets in 100 ul H2O: incubate at RT for 10 min on mixmate 900 rpm to re-suspend.

13) Make sure each sample is re-suspended by pipeting after step 13. Make notes on hardly re-suspendable samples.

14) 50 ul of re-suspended sample to indexing PCR→next generation sequencing (NGS).

15) Keep leftover at 4C

Technical Validation:

The current protocol was tested versus a protocol using 8% PEG8000 to precipitate microvesicles. The current protocol further comprises steps to reduce dsDNA in the oligonucleotide probing libraries.

Figure 12A:
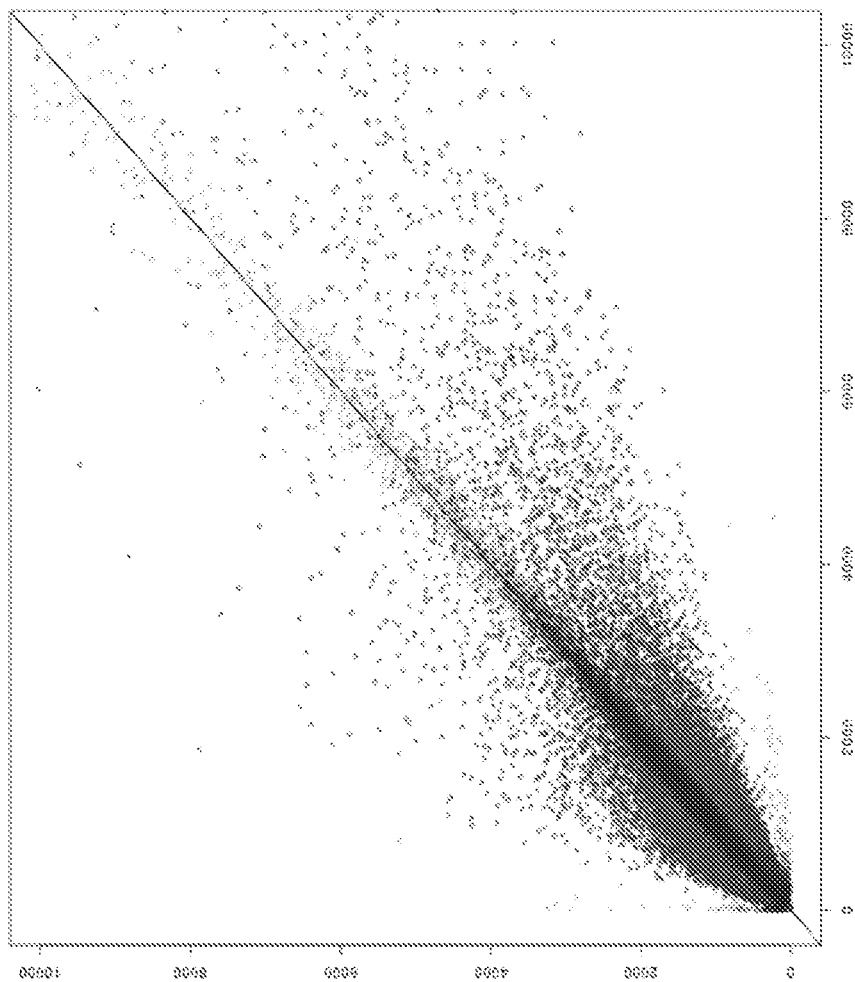

FIG. 12A shows the within sample variance (black) between binding replicates and the between sample variance (grey). Black is on top of grey, thus any observable grey oligo is informative about differences in the biology of two patient samples. This evaluation of Sources of Variance shows that the technical variances is significantly smaller than the biological variance.

Figure 12B:
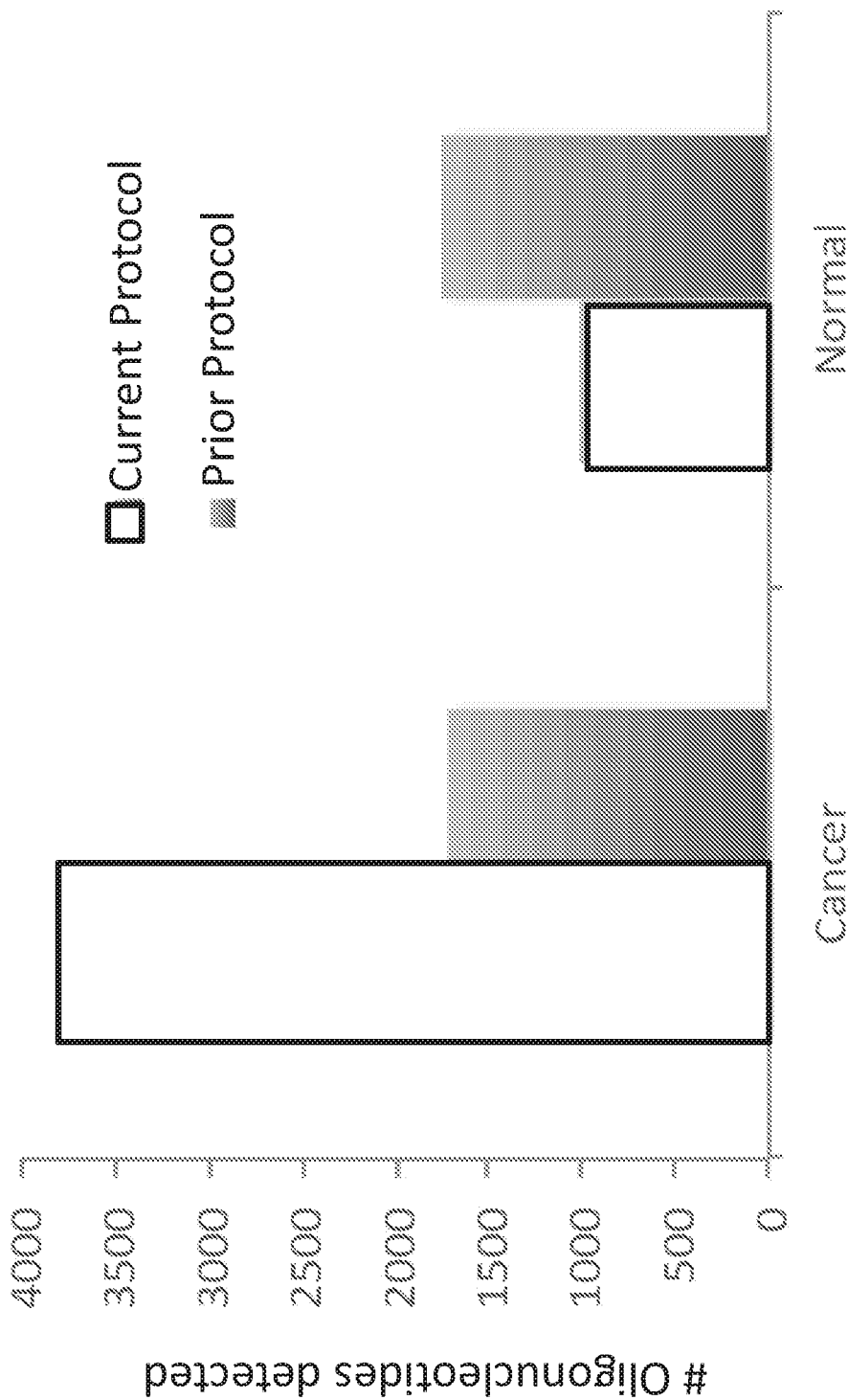

FIG. 12B shows the impact of using a higher proportion of single stranded DNA and PEG 6% isolation (white bars) compared to when there is a higher amount of double stranded DNA and 8% PEG (grey). This data indicates that the protocol in this Example improves biological separation between patients.

Figure 12C:
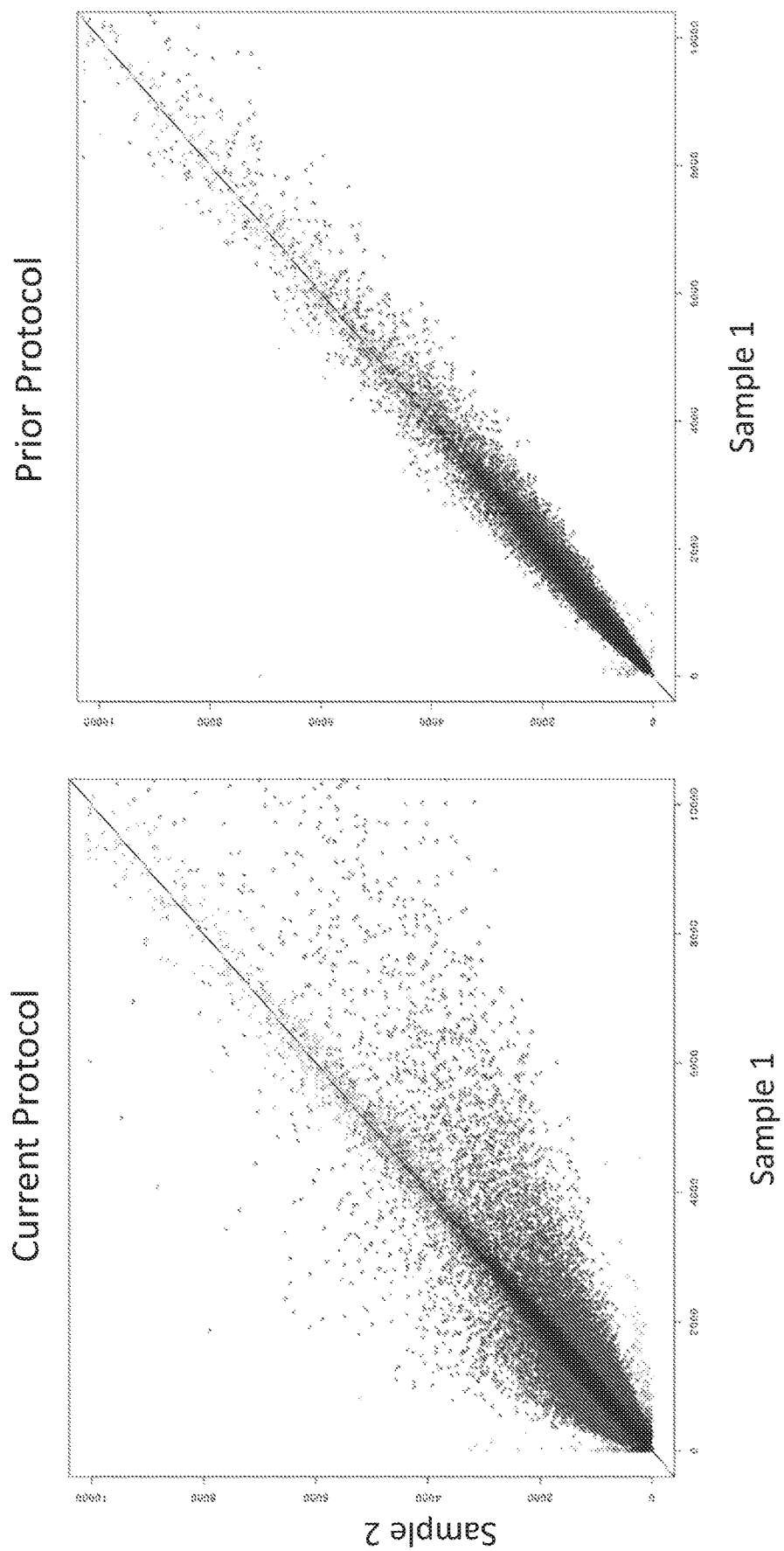

The plots in FIG. 12C show the difference between an earlier protocol (PEG 8% with increased dsDNA) and a modified protocol of the Example (PEG 6% no dsDNA). The black is the scatter between replicates (independent binding events) and the grey is the difference between patients. This data shows that the signal to noise increased significantly using the newer protocol.

Patient Testing:

The protocol above was used to test patient samples having the following characteristics:

TABLE 16

Patient characteristics

| Sample Type | Description |
|---|---|
| Cancer | Mixed type carcinoma; Malignant; |
| Cancer | Invasive, predominant intraductal component (8500/3) |
| Cancer | Fibrocystic Changes; Invasive lobular carcinoma - 8520/3; Lobular carcinoma in situ - 8520/2; Benign; In situ and grade 3 intraepith; Malignant; Fat necrosis, periductal inflammation, malignant cellsFat necrosis; Inflammation; Benign; |
| Cancer | Invasive, predominant intraductal component (8500/3) |
| Cancer | Mucinous (colloid) adenocarcinoma (8480/3) |
| Cancer | Invasive lobular carcinoma - 8520/3; Microcalcifications; Benign; Malignant; |
| Cancer | Otherfibrocystic changeInvasive, NOS (8500/3) |
| Cancer | Invasive ductal carcinoma, not otherwise specified (NOS) - 8500/3; Malignant; |
| Cancer | Invasive ductal carcinoma, not otherwise specified (NOS) - 8500/3; Malignant; |
| Cancer | Intraductal carcinoma, non-infiltrating, NOS (in situ) (8500/2) |
| Cancer | Atypical lobular hyperplasia Otherfibrocystic changes, inter and intralobular fibrosis, apocrine metaplasia, columnar cell change, microcalcificationsInvasive, NOS (8500/3) |
| Cancer | FibroadenomaInvasive, NOS (8500/3) |
| Cancer | Ductal carcinoma in situ - 8500/2; Invasive ductal carcinoma, not otherwise specified (NOS) - 8500/3; Microcalcifications; Benign; In situ and grade 3 intraepith; Malignant; |
| Cancer | Ductal carcinoma in situ - 8500/2; Invasive lobular carcinoma - 8520/3; Lobular carcinoma in situ - 8520/2; In situ and grade 3 intraepith; Malignant; |
| Cancer | Ductal carcinoma in situ - 8500/2; Invasive ductal carcinoma, not otherwise specified (NOS) - 8500/3; Microcalcifications; Benign; In situ and grade 3 intraepith; Malignant; Focal Micropapillary Features, invasive ductal carcinoma with micropapillary features, invasive ductal carcinoma with mucinous and micropapillary featInvasive ductal carcinoma with micropapillary and mucinous features; Invasive micropapillary carcinoma - 8507/3; Malignant; |
| Cancer | Invasive, predominant intraductal component (8500/3) |
| Cancer | Invasive ductal carcinoma, not otherwise specified (NOS) - 8500/3; Malignant; |
| Cancer | Invasive, NOS (8500/3) |
| Cancer | Infiltrating duct and lobular carcinoma (8522/3) |
| Cancer | Invasive, predominant in situ component (8520/3) |
| Non-Cancer | Otherusual ductal hyperplasia, apocrine metaplasia, microcysts, elastosis |
| Non-Cancer | Otherstromal fibrosis, fibrous cyst wall |
| Non-Cancer | Otherfibrocystic change, stromal fibrosis, cyst formation, microcalcifications, apocrine metaplasia, sclerosing adenosis, usual ductal hyperplasia |
| Non-Cancer | Otherfibrocystic changes, apocrine metaplasia, cystic change, usual ductal hyperplasia |
| Non-Cancer | Otherfibrocystic change, microcalcifications |
| Non-Cancer | Fibroadenoma |
| Non-Cancer | Otherintraductal papilloma, sclerosis, microcalcifications, stromal fibrosis |
| Non-Cancer | Fibroadenoma |
| Non-Cancer | Otherfat necrosis |
| Non-Cancer | Otherstromal fibrosis, microcalcifications |
| Non-Cancer | Otherfibrocystic change, microcystic change, focal secretory features |
| Non-Cancer | Otherstromal fibrosis |
| Non-Cancer | Fibroadenoma Otheradenosis, columnar cell change/hyperplasia, usual ductal hyperplasia |
| Non-Cancer | OtherFNA - insufficient material for diagnosis |
| Non-Cancer | Otherintraductal papilloma |
| Non-Cancer | Otherfibrocystic changes, duct ectasia, usual ductal hyperplasia, apocrine metaplasia, microcalcifications |

Microvesicles (and potentially other biological entities) were precipitated in blood (plasma) samples from the above patients using polymer precipitation with PEG as indicated above. The protocol was used to probe the samples with the oligonucleotide probe libraries. Sequences that bound the PEG precipitated samples were identified using next generation sequencing (NGS).

FIG. 12D shows scatter plots of a selection of results from testing the 40 patients listed previously. The spread in the data indicates that large numbers of oligos were detected that differed between samples. The number of significant oligos found is much greater than would be expected randomly as shown in Table 17. The table shows the number of oligonucleotides sorted by copy number detected and p-value. The d-# indicates the number copies of a sequence observed for the data in the rows.

TABLE 17

Expected versus observed sequences

| | Total Number | P-0.1 | P-0.05 | P-0.01 | P-0.005 |
|---|---|---|---|---|---|
| d-50 | 83,632 | 47,020 | 30,843 | 5,934 | 2,471 |
| d-100 | 52,647 | 29,106 | 19,446 | 3,893 | 1,615 |
| d-200 | 28,753 | 14,681 | 9,880 | 2,189 | 914 |
| d-500 | 10,155 | 4,342 | 2,927 | 725 | 315 |
| d-50 | 100.0% | 56.2% | 36.9% | 7.1% | 3.0% |
| d-100 | 100.0% | 55.3% | 36.9% | 7.4% | 3.1% |
| d-200 | 100.0% | 51.1% | 34.4% | 7.6% | 3.2% |

TABLE 17-continued

Expected versus observed sequences

| | Total Number | P-0.1 | P-0.05 | P-0.01 | P-0.005 |
|---|---|---|---|---|---|
| d-500 | 100.0% | 42.8% | 28.8% | 7.1% | 3.1% |
| Maximum expected | | 10.0% | 5.0% | 1.0% | 0.5% |

As a control, the cancer and non-cancer samples were randomly divided into two groups. Such randomization of the samples significantly reduced the number of oligos found that differentiate between sample groups. Indeed, there was a 50-fold increase in informative oligos between the cancer/non-cancer grouping versus random grouping. FIG. 12E shows data as in Table 17 and indicates the number of observed informative oligos between the indicated sample groups.

Figure 12F:
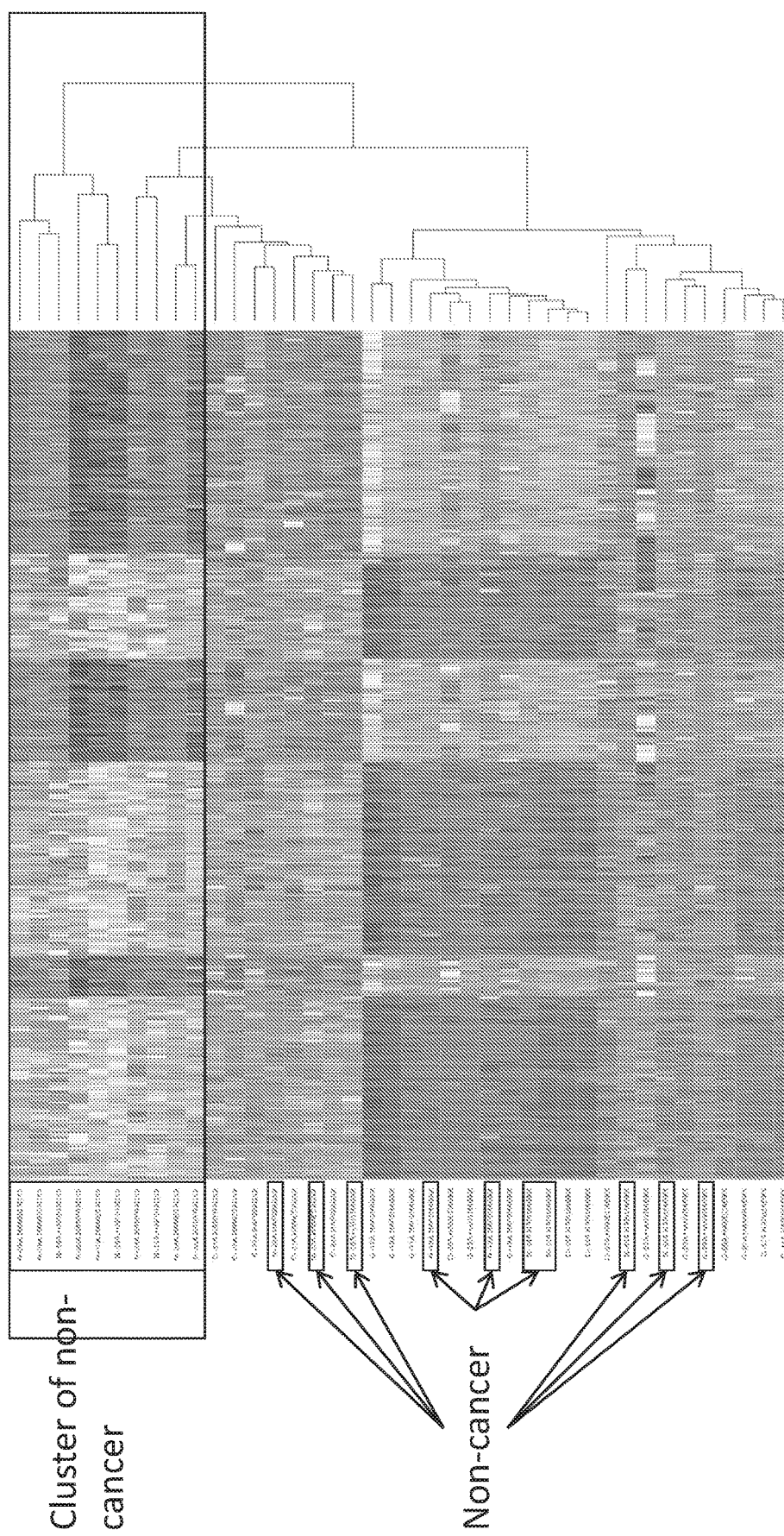
Figure 12G:
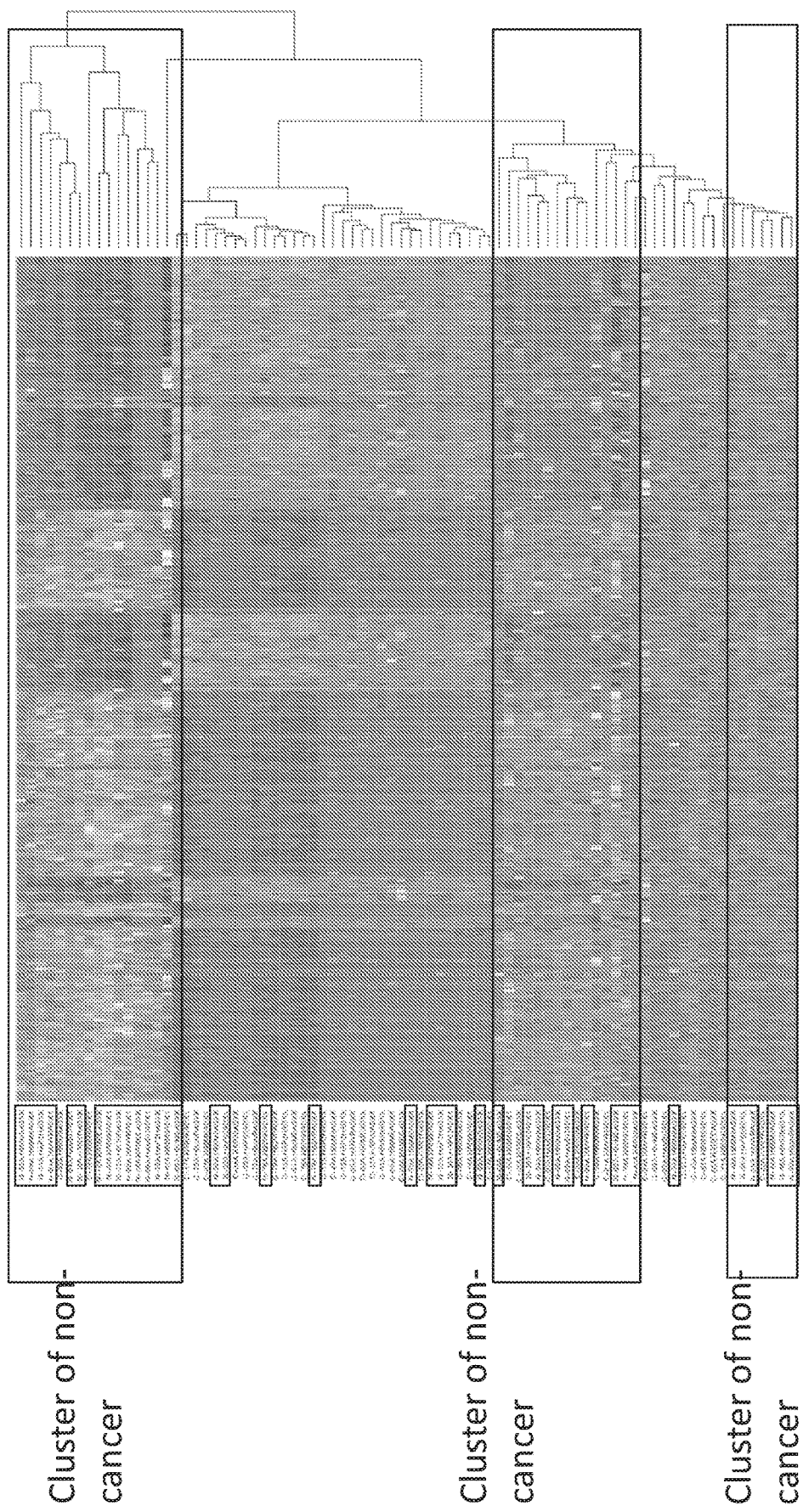

FIG. 12F shows distinct groups of oligos that differentiate between cancer and non-cancer samples. The figure shows a heatmap of the 40 samples tested with oligos selected that had more than 500 copies and p-value less than 0.005. There are clear subpopulations emerging with a distinct non-cancer cohort at the top. The non-cancer samples have boxes around them on the left axis. FIG. 12G is similar and shows results with an additional 20 cancer and 20 non-cancer samples. As shown, analysis with the 80 samples provides the emergence of more distinct and larger clusters.

The data for the additional 80 samples was also used to compare the consistency of informative oligos identified in different screening experiments. Of the 315 informative oligos identified using the first set of 40 patients, 86% of them showed fold-change in a consistent manner when tested on the independent set of 40 patients.

Example 22: Enrichment of Oligonucleotide Probes to Breast Cancer (BrCa) and Non-BrCa Derived Microvesicles Using a Balanced Library Design In this Example, a naïve ADAPT oligonucleotide library was screened to enrich oligonucleotides that identify microvesicles circulating in the blood of breast cancer patients and microvesicles circulating in the blood of healthy, control individuals (i.e., without breast cancer). The input library was the naïve F-TRin-35n-B 8-3s library, which comprises a 5' region (5' CTAGCATGACTGCAG-TACGT (SEQ ID NO. 131)) followed by the random naïve aptamer sequences of 35 nucleotides and a 3' region (5' CTGTCTCTTATACACATCTGACGCTGCCGACGA (SEQ ID NO. 132)). The "balanced" design is described in Example 23 of Int'l Patent Publication WO/2015/031694 (Appl. No. PCT/US2014/053306, filed Aug. 28, 2014). The working library comprised approximately $2 \times 10^{13}$ synthetic oligonucleotide sequences. The naïve library may be referred to as the "L0 Library" herein.

Figure 21A:
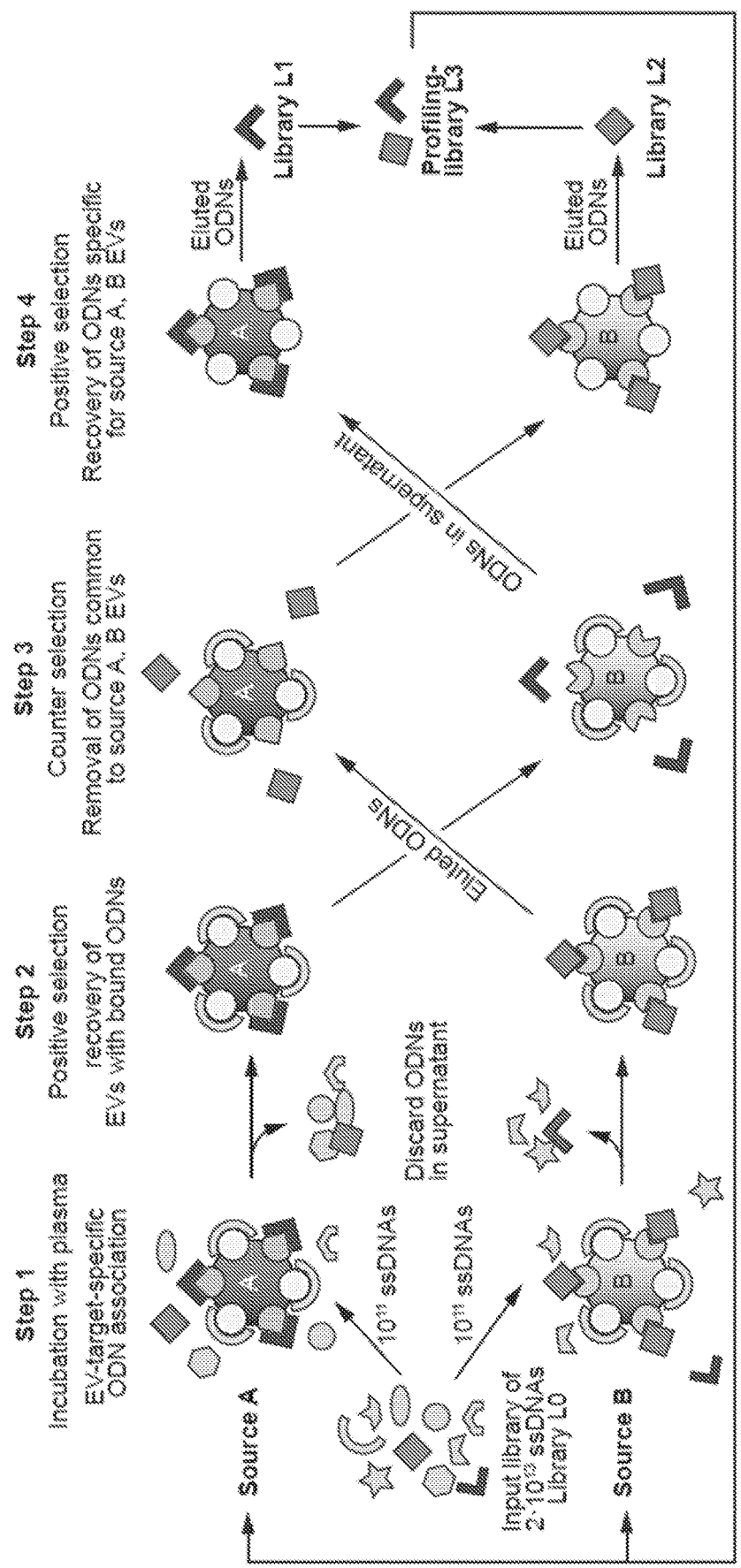
FIGS. 21A-C illustrate enriching a naïve oligonucleotide library with balanced design for oligonucleotides that differentiate between breast cancer and non-cancer microvesicles derived from plasma samples.

The L0 Library was enriched against fractionated plasma samples from breast cancer patients and from healthy (non-breast cancer) controls using the protocol shown in FIG. 21A. In Step 1, an aliquot of approximately $10^{11}$ sequences of PCR-amplified L0 was incubated with pooled blood-plasma from 59 breast cancer patients with positive biopsy (represented by "Source A" in FIG. 21A). In parallel, another aliquot of $10^{11}$ sequences was incubated with pooled blood-plasma from 30 patients with suspected breast cancer who proved negative on biopsy and 30 self declared healthy women (represented by "Source B" in FIG. 21A). In Step 2, microvesicles (extracellular vesicles, "EV") were precipitated using ultracentrifugation (UC) from both L0-samples. The EV-associated oligodeoxynucleotides (ODNs) were recovered from the respective pellets. In Step 3, a counter-selection step (Step 3) was carried out by incubation of each enriched library with plasma from the different cohorts to drive the selection pressure towards enrichment of ODNs specifically associated with each sample cohort. In this step, sequences contained in the EV pellets were discarded. In Step 4, a second positive selection was performed. In this step, the sequences contained in the respective supernatants (sn) from Step 3 were mixed with plasma from another aliquot of each positive control sample-population, and EVs were again isolated. EV-associated ODNs were recovered, representing two single-round libraries called library L1 for positive enrichment of cancer (positive biopsy) patients, and library L2 for the positive enrichment against control patients. In a final step, L1 and L2 were amplified by PCR, reverted to single stranded DNA (ssDNA), and mixed to yield library L3.

This enrichment scheme was iterated two times more using L3 as the input to further reduce the complexity of the profiling library to approximately $10^6$ different sequences. In Step 2, UC was used for partitioning of microvesicles, which may increase the specificity for the EV fraction. In Steps 3 and 4, partitioning was performed using PEG-precipitation. This procedure enriches for ODNs specific for each biological source. Library L3 contains those ODNs that are associated with targets characteristic for EV-populations from both sources, i.e. ODNs acting as aptamers that bind to molecules preferentially expressed in each source. A total of biopsy-positive (n=59), biopsy-negative (n=30), and self-declared normal (n=30) were used in the first round of L3 enrichment, while only the cancer and non-cancer samples were used in the subsequent rounds.

Figure 21C:
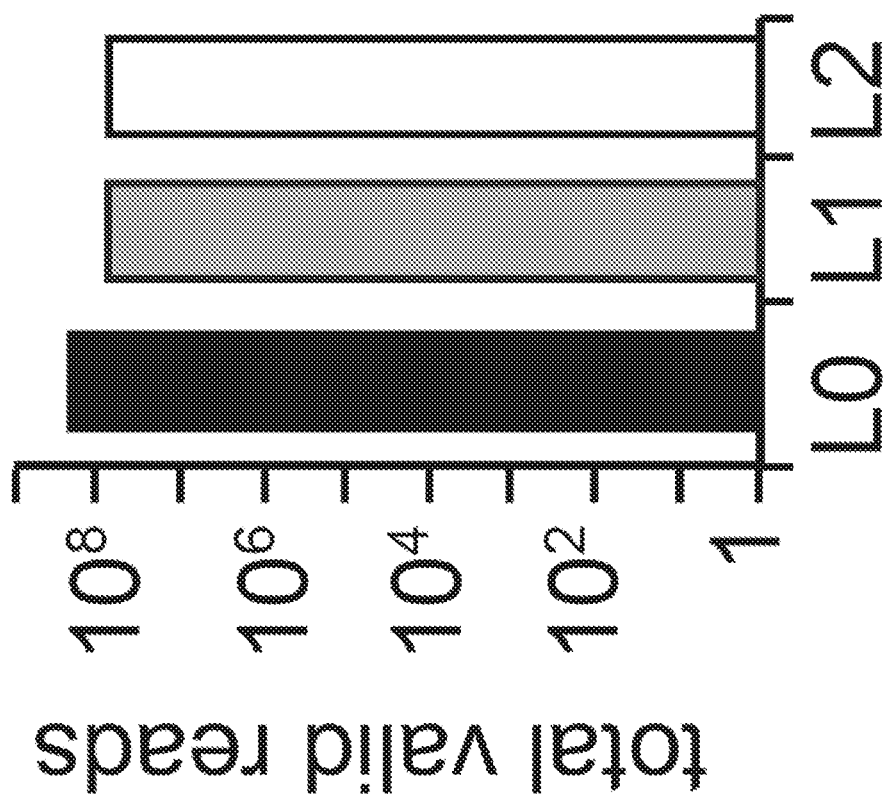
Figure 21B:
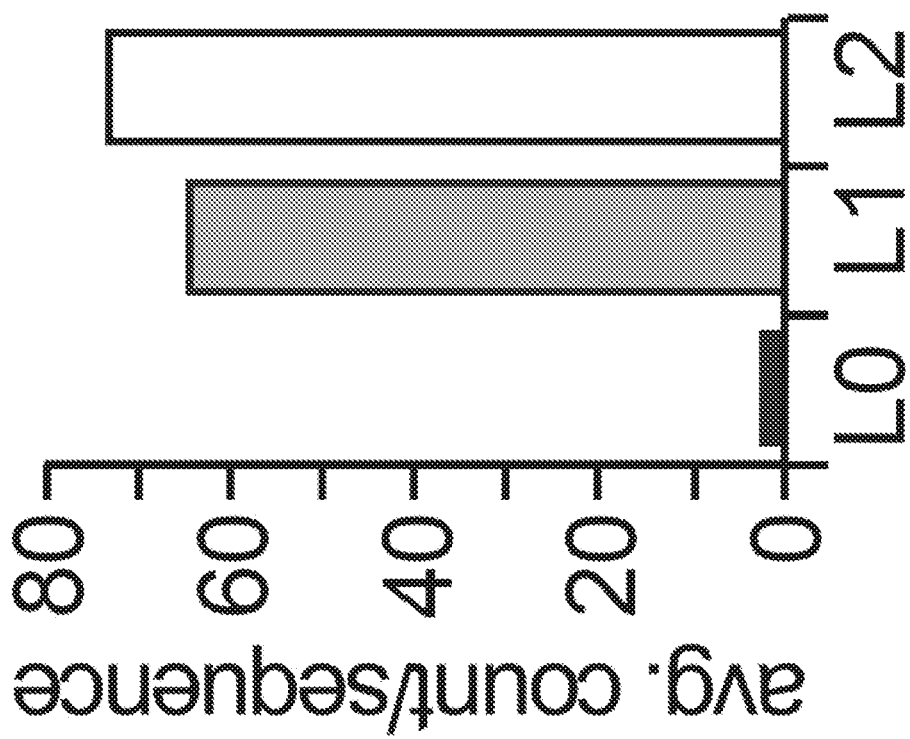

The enriched libraries were characterized using next-generation-sequencing (NGS) to measure copy numbers of sequences contained in each profiling library. NGS of L0 shows that the vast majority of sequences existed in low copy numbers, whereas libraries L1 and L2 showed significantly higher average counts per sequence (FIG. 21B) and a reduced amount of different sequences, with unaltered total valid reads, (FIG. 21C) consistent with an enrichment process.

Example 23: Analysis of ADAPT-Identified Biomarkers

As described herein, e.g., in the section entitled "Aptamer Target Identification," an unknown target recognized by an aptamer can be identified. In this Example, an oligonucleotide probe library (also referred to as Adaptive Dynamic Artificial Poly-ligand Targeting (ADAPT) libraries or Topographical Oligonucleotide Probe "TOP" libraries) was developed as described here and targets of the screened oligonucleotides were determined. This Example used a ADAPT library generated by enriching microvesicles collected from the blood of breast cancer patients and normal controls (i.e., non-cancer individuals). The enrichment protocols are described herein in Example 22.

Materials & Methods
SBED Library Conjugation
A naïve F-TRin-35n-B 8-3s library was enriched against microvesicles from normal female plasma. The naïve unenriched library comprised a 5' region (5' CTAGCATGACT-GCAGTACGT (SEQ ID NO. 131)) followed by the random naïve aptamer sequences of 35 nucleotides and a 3' region (5'

CTGTCTCTTATACACATCTGACGCTGCCGACGA (SEQ ID NO. 132)). The naïve library may be referred to as the "L0 Library" herein and the enriched library referred to as the "L2 library." See Example 22. The screened library was PCR amplified with a C6-amine sense primer (C6 Amine-5' CTAGCATGACTGCAGTACGT 3' (SEQ ID NO. 131)) and a 5' phosphorylated anti-sense primer (5' Phos TCGTCGGCAGCGTCA (SEQ ID NO. 133)), the purified product was strand separated and conjugated with sulfo-SBED (Thermo Scientific) according to Vinkenborg et al. (Angew Chem Int Ed Engl. 2012, 51:9176-80) with the following modifications: The reaction was scaled down to 5 μg C6-amine DNA library (8.6 μM) in 25 mM HEPES-KOH, 0.1M NaCl, pH 8.3 and incubated with either 100-fold molar excess of sulfo-SBED or DMSO in a 21 μL volume for 30 min at room temp in the dark. The SBED-conjugated library was immediately separated from the unconjugated library and free sulfo-SBED by injection onto a Waters X-Bridge™ OST C-18 column (4.6 mm×50 mm) and fractionated by HPLC (Agilent 1260 Infinity) with a linear gradient Buffer A: 100 mM TEAA, pH7.0, 0% ACN to 100 mM TEAA, pH7.0, 25% ACN at 0.2 ml/min, 65° C. There SBED-conjugated fractions were desalted into water with Glen Gel-Pak™ Cartridges and concentrated by speed-vac. SBED conjugation was confirmed by LC-MS and/or a dot blot with streptavidin-HRP detection.

Binding Reaction and Cross-Linking

SBED library functionalization was tested by performing the ADAPT assay with SBED vs DMSO mock conjugated control C6-amine library and sequenced on a HiSeq 2500TM (Illumina Corp.). The aptamer precipitation was performed with forty-eight ADAPT reactions incubated for 1 hr with end-over-end rotation at room temp with a 5 ng input of SBED conjugated library per 200 μL of plasma (pre-spun to remove cellular debris at 10,000×g for 20 min, 4° C.) in 1×PBS, 3 mM MgCl$_2$, 0.01 mM dextran sulfate, 40 ng/μl salmon sperm DNA and 40 ng/μl yeast transfer RNA, and cOmplete ULTRA Mini EDTA-free TM protease inhibitors (Roche) equivalent to ~240 ng library and 9.6 mls plasma. A duplicate set of 48 reactions was prepared with the DMSO control C6-amine library. Aptamer library-protein complexes were precipitated with incubation in 6% PEG8000 for 15 min at 4° C. then centrifuged at 10,000×g for 5 min. Pellets were washed with 1 ml 1×PBS, 3 mM MgCl2 by gentle inversion to remove unbound aptamers. The washed pellets were resuspended in 100 μL of water and subjected to photo-cross-linking at 365 nm with a hand-held 3 UV (254 NM/302 NM/365 NM) lamp, 115 volts (Thermo Scientific) for 10 min on ice with 1-2 cm between the 96-well plate and lamp.

Oligonucleotide Precipitation

Cross-linked reactions were subsequently pooled (~4.8 ml) per library or 4.8 ml of 1×PBS (AP bead only control) and incubated with 10 μL of Prepared Dynabeads® MyOne™ Streptavidin C1 (10 mg/ml) (Life Technologies) (pre-washed with 1×PBS, 0.01% Triton X-100) shaking for 1 hr at room temp. Beads were transferred to an eppendorf tube and lysed for 20 min with lysis buffer (50 mM Tris-HCl, 10 mM MgCl2, 200 mM NaCl, 0.5% Triton X-100, 5% glycerol, pH 7.5) on ice, washed 3 times with wash buffer 1 (10 mM Tris-HCl, 1 mM EDTA, 2M NaCl, 1% Triton X-100), followed by 2 times with wash buffer 2 (10 mM Tris-HCl, 1 mM EDTA, 2M NaCl, 0.01% Triton X-100) as described by Vinkenborg et al. (Angew Chem Int Ed Engl. 2012, 51:9176-80). Cross-linked proteins were eluted by boiling 15 min in 1×LDS sample buffer with reducing agent added (Life Technologies) and loaded on a 4-12% SDS-PAGE gradient gel (Life Technology). Proteins and DNA were detected with double staining with Imperial Blue Protein Stain (Thermo Scientific) followed by Prot-SIL2 TM silver stain kit (Sigma) used according to manufacturer's instructions in order to enhance sensitivity and reduce background.

Protein Identification

Protein bands that appeared to differ between the cancer and normal were excised from the gradient gels and subjected to liquid chromatography-tandem mass spectrometry (LC-MS/MS).

Results

Figure 13:
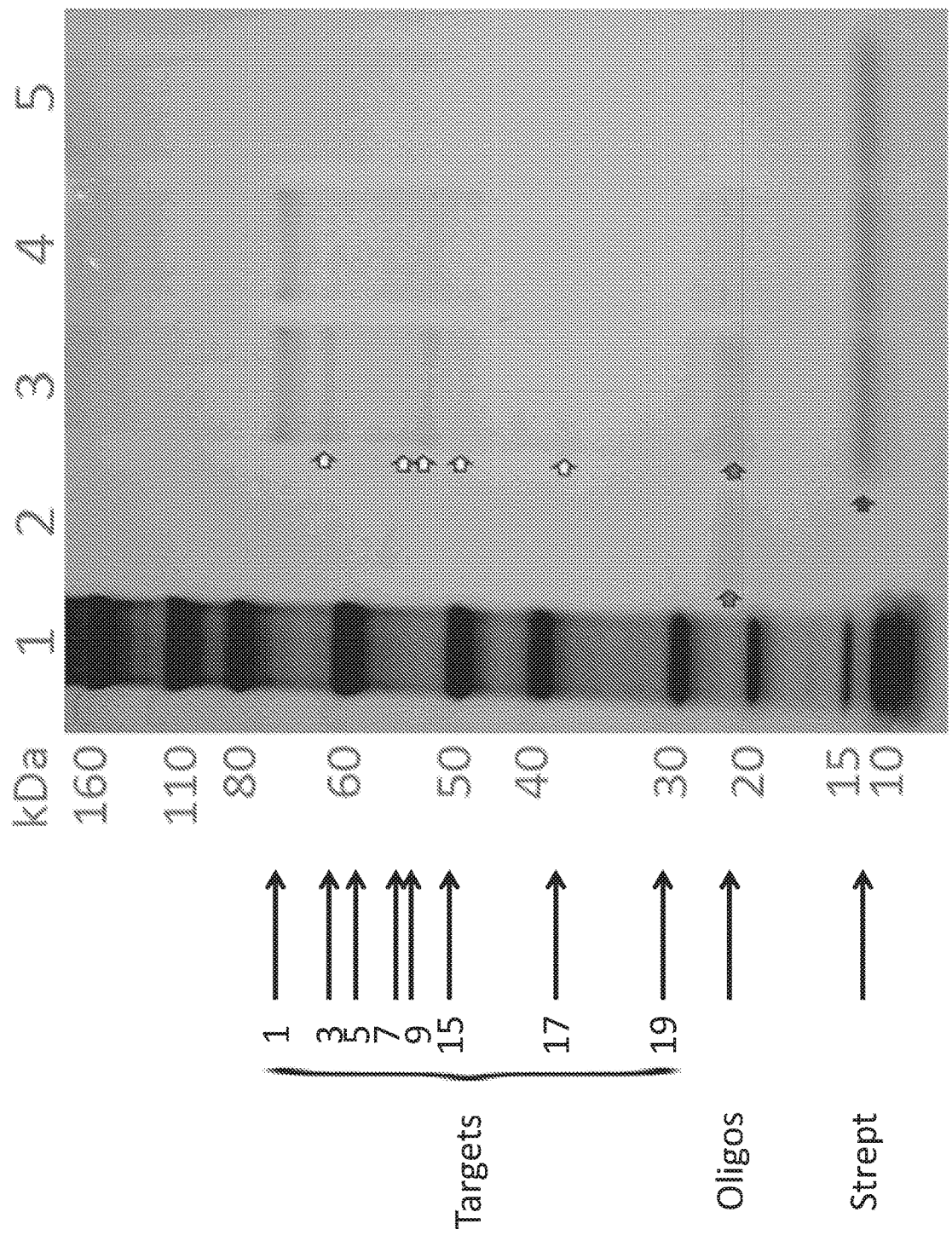
FIG. 13 shows protein targets of oligonucleotide probes run on a silver stained SDS-PAGE gel.

ADAPT protein targets were identified from bands cut from a silver stained SDS-PAGE gel (FIG. 13). Aptamer-SBED protein complexes (lane 3) or Aptamer-DMSO protein complexes (control-lane 4) were precipitated with 6% PEG8000, subjected to UV photo-cross-linking, and pulled-down with Streptavidin coated beads. Eluate was analyzed under reducing conditions by SDS-PAGE and silver staining. Aptamer library alone (5 ng) (lane 1) was loaded as a control for migration of the library (second to bottom arrows) and an equal volume of eluate from a bead only sample (lane 4) was loaded as a streptavidin control to control for potential leaching of the streptavidin monomer (bottom arrow) under the harsh elution conditions. Upper arrows ("Targets") indicate specific or more predominant bands identified with the SBED-conjugated library vs. the mock DMSO treated control C6-amine library. Indicated target protein bands were cut out and sent for LC-MS/MS protein identification or indicated DNA library bands were eluted, reamplified and sequenced. The identified proteins are those that appeared as upregulated in the normal samples.

Tables 18-25 list human proteins that were identified in 8 bands excised from the silver stained gel. In all tables the proteins are those identified in the oligo-SBED protein complexes with proteins identified in the corresponding control lanes removed. The band numbers in the tables indicate different bands cut from the gel (FIG. 13). Accession numbers in the table are from the UniProt database (www.uniprot.org). "GN=" is followed by the gene name. Various protein classifications indicated in the Tables 18-25 include Nucleic Acid Binding Proteins (NAB), Tumor suppressors (TS), cell adhesion/cytoskeletal (CA/CK) and abundant plasma proteins (ABP). In Table 18, the proteins listed below the row "SBED associated" were identified by peptide fragments linked to SBED, indicating that the peptides are from near the cross-linking sites. Class is not reported for these proteins.

TABLE 18

| Band 3 | | |
|---|---|---|
| Accession number | Class | Protein name |
| P02538 | CA/CK | Keratin, type II cytoskeletal 6A GN = KRT6A |
| P15924 | CA/CK | Desmoplakin GN = DSP |

TABLE 18-continued

Band 3

| Accession number | Class | Protein name |
|---|---|---|
| P04259 | CA/CK | Keratin, type II cytoskeletal 6B GN = KRT6B |
| P60709 | CA/CK | Actin, cytoplasmic 1 GN = ACTB |
| P20930 | CA/CK | Filaggrin GN = FLG |
| P07476 | CA/CK | Involucrin GN = IVL |
| P31947 | TS | 14-3-3 protein sigma GN = SFN |
| Q7Z794 | CA/CK | Keratin, type II cytoskeletal 1b GN = KRT77 |
| P02545 | NAB | Prelamin-A/C GN = LMNA |
| P19012 | CA/CK | Keratin, type I cytoskeletal 15 GN = KRT15 |
| P47929 | CA/CK & TS | Galectin-7 GN = LGALS7 |
| P11142 | | Heat shock cognate 71 kDa protein GN = HSPA8 |
| P58107 | NAB | Epiplakin GN = EPPK1 |
| P08107 | | Heat shock 70 kDa protein 1A/1B GN = HSPA1A |
| Q02413 | CA/CK | Desmoglein-1 GN = DSG1 |
| P06396 | CA/CK | Gelsolin GN = GSN |
| O60814 | NAB | Histone H2B type 1-K GN = HIST1H2BK |
| P68104 | NAB | Elongation factor 1-alpha 1 GN = EEF1A1 |
| P05387 | NAB | 60S acidic ribosomal protein P2 GN = RPLP2 |
| Q7RTS7 | CA/CK | Keratin, type II cytoskeletal 74 GN = KRT74 |
| P31946 | TS | 14-3-3 protein beta/alpha GN = YWHAB |
| Q13835 | CA/CK | Plakophilin-1 GN = PKP1 |
| P14923 | CA/CK | Junction plakoglobin GN = JUP |
| P09651 | NAB | Heterogeneous nuclear ribonucleoprotein A1 GN = HNRNPA1 |
| P07900 | | Heat shock protein HSP 90-alpha GN = HSP90AA1 |
| Q96KK5 | NAB | Histone H2A type 1-H GN = HIST1H2AH |
| P04406- | CA/CK | Glyceraldehyde-3-phosphate dehydrogenase GN = GAPDH |
| P10412 | NAB | Histone H1.4 GN = HIST1H1E |
| P04792 | | Heat shock protein beta-1 GN = HSPB1 |
| Q9NZT1 | | Calmodulin-like protein 5 GN = CALML5 |
| P81605 | | Dermcidin GN = DCD |
| P27348 | TS | 14-3-3 protein theta GN = YWHAQ |
| P55072 | NAB | Transitional endoplasmic reticulum ATPase GN = VCP |
| Q09666 | NAB | Neuroblast differentiation-associated protein AHNAK GN = AHNAK |
| P23246 | NAB | Splicing factor, proline- and glutamine-rich GN = SFPQ |
| Q15149 | CA/CK | Plectin GN = PLEC |
| Q8NC51 | NAB | Plasminogen activator inhibitor 1 RNA-binding protein GN = SERBP1 |
| P07237 | | Protein disulfide-isomerase GN = P4HB |
| O60437 | CA/CK | Periplakin GN = PPL |
| P01717 | ABP | Ig lambda chain V-IV region Hil |
| P55884 | NAB | Eukaryotic translation initiation factor 3 subunit B GN = EIF3B |
| P11021 | | 78 kDa glucose-regulated protein GN = HSPA5 |
| P01024 | | Complement C3 GN = C3 |
| P04350 | CA/CK | Tubulin beta-4A chain GN = TUBB4A |
| P01857 | ABP | Ig gamma-1 chain C region GN = IGHG1 |
| P61247 | NAB | 40S ribosomal protein S3a GN = RPS3A |
| P62937 | | Peptidyl-prolyl cis-trans isomerase A GN = PPIA |
| O15020 | CA/CK | Spectrin beta chain, non-erythrocytic 2 GN = SPTBN2 |
| P30101 | | Protein disulfide-isomerase A3 GN = PDIA3 |
| Q6KB66 | CA/CK | Keratin, type II cytoskeletal 80 GN = KRT80 |
| Q9UJU6 | CA/CK | Drebrin-like protein GN = DBNL |
| P47914 | NAB | 60S ribosomal protein L29 GN = RPL29 |
| P39023 | NAB | 60S ribosomal protein L3 GN = RPL3 |
| A6NMY6 | CA/CK | Putative annexin A2-like protein GN = ANXA2P2 |
| P60174 | CA/CK | Triosephosphate isomerase GN = TPI1 |
| P35241 | CA/CK | Radixin GN = RDX |
| P07305 | NAB | Histone H1.0 GN = H1F0 |
| P15259 | CA/CK | Phosphoglycerate mutase 2 GN = PGAM2 |
| P0CG05 | ABP | Ig lambda chain C regions GN = IGLC2 |
| Q92817 | CA/CK | Envoplakin GN = EVPL |
| P06733 | NAB | MBP-1 of Alpha-enolase GN = ENO1 |
| P22626 | NAB | Heterogeneous nuclear ribonucleoproteins A2/B1 GN = HNRNPA2B1 |
| P62424 | NAB | 60S ribosomal protein L7a GN = RPL7A |
| P60660 | CA/CK | Myosin light polypeptide 6 GN = MYL6 |
| P04083 | NAB | Annexin A1 GN = ANXA1 |
| Q14134 | NAB | Tripartite motif-containing protein 29 GN = TRIM29 |
| P39019 | NAB | 40S ribosomal protein S19 GN = RPS19 |
| Q8WVV4 | CA/CK | Protein POF1B GN = POF1B |
| Q02878 | NAB | 60S ribosomal protein L6 GN = RPL6 |
| Q9Y6X9 | NAB | MORC family CW-type zinc finger protein 2 GN = MORC2 |
| Q9NQC3 | NAB | Reticulon-4 GN = RTN4 |
| Q5T753 | CA/CK | Late cornified envelope protein 1E GN = CA/CK E |
| | | SBED associated |
| P56202 | | Cathepsin W |
| P80188 | | Neutrophil gelatinase-associated lipocalin precursor |

TABLE 18-continued

Band 3

| Accession number | Class | Protein name |
| --- | --- | --- |
| Q13017 | | Rho GTPase-activating protein 5 |
| Q6UB98 | | Ankyrin repeat domain-containing protein 12 |
| P54753 | | Ephrin type-B receptor 3 |
| Q5JRS4 | | Olfactory receptor 10J3 |
| P82279 | | Protein crumbs homolog 1 |
| O00763 | | Acetyl-CoA carboxylase 2 |
| P02533; P08779 | | Keratin, type 1 cytoskeletal 14, 16 |
| P26012 | | Integrin beta-8 |
| Q14766 | | Latent-transforming growth factor beta-binding protein 1 |

TABLE 19

Band 9

| Accession number | Class | Protein name |
| --- | --- | --- |
| P61626 | | Lysozyme C GN = LYZ |
| Q9HCK1 | NAB | DBF4-type zinc finger-containing protein 2 GN = ZDBF2 |

TABLE 20

Band 1

| Accession number | Class | Protein name |
| --- | --- | --- |
| P01834 | ABP | Ig kappa chain C region GN = IGKC |
| P01765 | ABP | Ig heavy chain V-III region TIL |
| P04003 | NAB | C4b-binding protein alpha chain GN = C4BPA |
| P60709 | CA/CK | Actin, cytoplasmic 1 GN = ACTB |
| Q5T751 | CA/CK | Late cornified envelope protein 1C GN = LCE1C |

TABLE 21

Band 5

| Accession number | Class | Protein name |
| --- | --- | --- |
| P01860 | ABP | Ig gamma-3 chain C region GN = IGHG3 |
| O60902 | NAB | Short stature homeobox protein 2 GN = SHOX2 |

TABLE 22

Band 7

| Accession number | Class | Protein name |
| --- | --- | --- |
| Q04695 | CA/CK | Keratin, type I cytoskeletal 17 GN = KRT17 |
| Q7Z794 | CA/CK | Keratin, type II cytoskeletal 1b GN = KRT77 |
| Q6KB66 | CA/CK | Keratin, type II cytoskeletal 80 GN = KRT80 |
| P01833 | | Polymeric immunoglobulin receptor GN = PIGR |
| P01042 | | Kininogen-1 GN = KNG1 |
| Q02413 | CA/CK | Desmoglein-1 GN = DSG1 |
| P15924 | CA/CK | Desmoplakin GN = DSP |
| Q8TF72 | | Protein Shroom3 GN = SHROOM3 |
| P02671 | ABP | Fibrinogen alpha chain GN = FGA |
| Q5T749 | CA/CK | Keratinocyte proline-rich protein GN = KPRP |
| Q5VZP5 | | Inactive dual specificity phosphatase 27 GN = DUSP27 |

TABLE 22-continued

Band 7

| Accession number | Class | Protein name |
| --- | --- | --- |
| Q5T751 | CA/CK | Late cornified envelope protein 1C GN = LCE1C |
| Q9UL12 | | Sarcosine dehydrogenase, mitochondrial GN = SARDH |
| P00698 | | Lysozyme C OS = Gallus gallus GN = LYZ |
| Q8N114 | | Protein shisa-5 GN = SHISA5 |

TABLE 23

Band 15

| Accession number | Class | Protein name |
| --- | --- | --- |
| P08238 | | Heat shock protein HSP 90-beta GN = HSP90AB1 |
| P68104 | NAB | Elongation factor 1-alpha 1 GN = EEF1A1 |
| P02675 | ABP | Fibrinogen beta chain GN = FGB |
| Q8TF72 | | Protein Shroom3 GN = SHROOM3 |
| P0CG05 | ABP | Ig lambda-2 chain C regions GN = IGLC2 |
| P78386 | CA/CK | Keratin, type II cuticular Hb5 GN = KRT85 |
| Q7Z5Y6 | | Bone morphogenetic protein 8A GN = BMP8A |
| O14633 | CA/CK | Late cornified envelope protein 2B GN = LCE2B |

TABLE 24

Band 17

| Accession number | Class | Protein name |
| --- | --- | --- |
| P02538 | CA/CK | Keratin, type II cytoskeletal 6A GN = KRT6A |
| P01834 | ABP | Ig kappa chain C region GN = IGKC |
| P06702 | | Protein S100-A9 GN = S100A9 |
| P68104 | NAB | Elongation factor 1-alpha 1 GN = EEF1A1 |
| P01024 | | Complement C3 GN = C3 |
| P81605 | | Dermcidin GN = DCD |
| P05109 | | Protein S100-A8 GN = S100A8 |
| Q5T751 | CA/CK | Late cornified envelope protein 1C GN = LCE1C |

TABLE 25

Band 19

| Accession number | Class | Protein name |
| --- | --- | --- |
| P02768 | NAB | Serum albumin GN = ALB |
| P0CG05 | ABP | Ig lambda-2 chain C regions GN = IGLC2 |
| P06702 | | Protein S100-A9 GN = S100A9 |

TABLE 25-continued

Band 19

| Accession number | Class | Protein name |
|---|---|---|
| P08238 | | Heat shock protein HSP 90-beta GN = HSP90AB1 |
| P60709 | CA/CK | Actin, cytoplasmic 1 GN = ACTB |
| P13647 | CA/CK | Keratin, type II cytoskeletal 5 GN = KRT5 |
| P01616 | ABP | Ig kappa chain V-II region MIL |
| Q86YZ3 | CA/CK | Hornerin GN = HRNR |
| P01857 | ABP | Ig gamma-1 chain C region GN = IGHG1 |
| P62805 | NAB | Histone H4 GN = HIST1H4A |
| P59665 | | Neutrophil defensin 1 GN = DEFA1 |
| P61626 | | Lysozyme C GN = LYZ |
| P01024 | ABP | Complement C3 GN = C3 |
| Q8TF72 | | Protein Shroom3 GN = SHROOM3 |
| P83593 | ABP | Ig kappa chain V-IV region STH (Fragment) |
| P01700 | ABP | Ig lambda chain V-I region HA |
| P01877 | ABP | Ig alpha-2 chain C region GN = IGHA2 |
| Q9UL12 | | Sarcosine dehydrogenase, mitochondrial GN = SARDH |
| Q6NXT2 | NAB | Histone H3.3C GN = H3F3C |
| P02788 | NAB | Lactotransferrin GN = LTF |
| P02787 | ABP | Serotransferrin GN = TF |

Certain proteins were identified in multiple bands. For example, IGLC2 was identified in bands 3, 15 and 19 and SHROOM3 was identified in bands 7, 15, 19. This may be due to degradation products, isoforms or the like. These experiments identified 108 proteins (plus 2 lysozyme controls), comprising among others 34 Nucleic Acid Binding Proteins (NAB) where 7 of the 34 are putative tumor suppressors/repressors; 37 cell adhesion/cytoskeletal (CA/CK); and 14 abundant plasma proteins (ABP). All of the tumor suppressors/repressors are DNA/RNA binding proteins. Other proteins comprise chaperones, signaling molecules etc.

For comparison to the above pull-down results with the enriched L2 library, mass spectrometry was used to identify proteins in whole plasma samples ("neat plasma") (Table 26, row "Neat"), in PEG enriched plasma fractions (comprising a microvesicle-containing fraction) (Table 26, row "PEG"), and in unenriched L0 library pull-down (Table 26, row "Unenriched") using the same healthy (non-breast cancer) plasma samples as described above (column "Plasma," rows "Non-cancer" in the table). Descriptions in the table comprise the gene name followed by accession numbers from the UniProt database (www.uniprot.org) in parentheses. 81 proteins were pulled down by L2 (Tables 18-25) that were not detectable in the PEG-precipitated and neat plasma, indicating that these proteins became enriched due to their interaction with L2 oligonucleotide probes. Further details are found in Example 28 of International Patent Application PCT/US15/62184, filed Nov. 23, 2015, which application is incorporated by reference herein in its entirety. The methods above were further repeated to identify proteins that were identified in cancer samples using pull-down with the L1 library (column "Plasma," rows "Cancer" in the table). With the proteins identified in the cancer plasma samples, the row "Non-SBED" and "SBED" refer to proteins identified by peptide fragments that were unassociated with or associated with SBED, respectively.

TABLE 26

| | | Proteins identified in plasma |
|---|---|---|
| Plasma | Sample | Description (Gene Name (Accession)) |
| Non-cancer | Neat | ALB (P02768), C3 (P01024), APOB (P04114), TF (P02787), A2M (P01023), C4B (P0C0L5), C4A (P0C0L4), FGA (P02671), FGB (P02675), CP (P00450), IGKC (P01834), IGHG1 (P01857), HP (P00738), FGG (P02679), IGHG3 (P01860), CFH (P08603), GC (P02774), IGHG2 (P01859), SERPINA1 (P01009), ITIH4 (Q14624), SERPINC1 (P01008), IGHM (P01871), HPR (P00739), CFB (P00751), APOA1 (P02647), FN1 (P02751), IGLL5 (B9A064), PLG (P00747), A1BG (P04217), ITIH2 (P19823), SERPINA3 (P01011), KNG1 (P01042), IGHG4 (P01861), APOA4 (P06727), F2 (P00734), HPX (P02790), C4BPA (P04003), ITIH1 (P19827), IGHA1 (P01876), IGLC2 (P0CG05), SERPING1 (P05155), GSN (P06396), PON1 (P27169), AGT (P01019), APOH (P02749), HRG (P04196), APCS (P02743), AFM (P43652), IGHA2 (P01877), APOE (P02649), AHSG (P02765), SERPIND1 (P05546), C5 (P01031), AMBP (P02760), ORM1 (P02763), AZGP1 (P25311), KRT1 (P04264), CFI (P05156), HBB (P68871), CD5L (O43866), C9 (P02748), RBP4 (P02753), VTN (P04004), SERPINA6 (P08185), SERPINF2 (P08697), CLU (P10909), KRT2 (P35908), C1QC (P02747), TTR (P02766), Ig kappa chain V-II region TEW (P01617), Ig heavy chain V-III region BUT (P01767), Ig heavy chain V-III region TUR (P01779), APOA2 (P02652), ORM2 (P19652), CFHR1 (Q03591), PGLYRP2 (Q96PD5), LYZ (P00698), Ig kappa chain V-IV region Len (P01625), Ig heavy chain V-III region GAL (P01781), IGHD (P01880), C1QB (P02746), C8A (P07357), C8G (P07360), KRT10 (P13645), APOL1 (O14791), IGJ (P01591), KLKB1 (P03952), Ig lambda chain V region 4A (P04211), Ig kappa chain V-III region VG (Fragment) (P04433), HBA1 (P69905), APOM (O95445), C1R (P00736), F12 (P00748), Ig lambda chain V-III region SH (P01714), Ig lambda chain V-IV region Hil (P01717), Ig heavy chain V-III region WEA (P01763), Ig heavy chain V-II region NEWM (P01825), LRG1 (P02750), IGKV4-1 (P06312), PROS1 (P07225), PRSS1 (P07477), C7 (P10643), C6 (P13671), CPN2 (P22792), SERPINF1 (P36955), Ig lambda chain V-III region LOI (P80748), ABCF1 (Q8NE71), FCN3 (O75636), F10 (P00742), Ig heavy chain V-I region HG3 (P01743), Ig heavy chain V-III region HIL (P01771), Ig heavy chain V-II region OU (P01814), Ig kappa chain V-I region BAN (P04430), APOD (P05090), C2 (P06681), C8B (P07358), LPA (P08519), C1S (P09871), HIST1H1D (P16402), Ig heavy chain V-I region V35 (P23083), LGALS3BP (Q08380), ATF7IP (Q6VMQ6), RASSF6 (Q6ZTQ3), MTMR14 (Q8NCE2), DCHS1 (Q96JQ0), HIST1H2AH (Q96KK5), HMCN1 (Q96RW7), UPF3A (Q9H1J1), IGLC7 (A0M8Q6), UNC13B (O14795), APBA3 (O96018), GSN (P06396), C4A (P0C0L4), PZP (P20742), SERPINA4 (P29622), SHMT2 (P34897), KRT9 (P35527), SEPP1 (P49908), COG7 (P83436), ITIH3 (Q06033), TMEM198 (Q66K66), F13A1 (P00488), Ig kappa chain V-I region Lay (P01605), S100A6 (P06703), KRT5 (P13647), CDH2 (P19022), SAA4 (P35542), RXRG (P48443), ARFGEF3 (Q5TH69), IQCE (Q6IPM2), C19orf68 (Q86XI8), CELSR3 (Q9NYQ7), C1RL (Q9NZP8), SARDH (Q9UL12), MYH4 (Q9Y623) |

TABLE 26-continued

Proteins identified in plasma

| Plasma | Sample | Description (Gene Name (Accession)) |
|---|---|---|
| Non-cancer | PEG | C3 (P01024), A2M (P01023), APOB (P04114), IGKC (P01834), C4A (P0C0L4), C4B (P0C0L5), FGB (P02675), ALB (P02768), CFH (P08603), IGHG1 (P01857), FGA (P02671), FN1 (P02751), PLG (P00747), IGHM (P01871), FGG (P02679), TF (P02787), C5 (P01031), CP (P00450), IGHG2 (P01859), IGLC2 (P0CG05), Ig mu heavy chain disease protein (P04220), ITIH1 (P19827), PZP (P20742), IGHG3 (P01860), IGLL5 (B9A064), HP (P00738), C4BPA (P04003), ITIH2 (P19823), IGHA1 (P01876), KRT1 (P04264), KRT10 (P13645), APOE (P02649), Ig kappa chain V-I region DEE (P01597), AMBP (P02760), F2 (P00734), C7 (P10643), C6 (P13671), ITIH4 (Q14624), CFB (P00751), IGHG4 (P01861), APOH (P02749), APOA1 (P02647), CD5L (O43866), C1R (P00736), HPR (P00739), Ig kappa chain V-I region Scw (P01609), IGHA2 (P01877), CFHR1 (Q03591), KRT2 (P35908), Ig kappa chain V-III region SIE (P01620), HRG (P04196), Ig heavy chain V-III region BRO (P01766), C1QB (P02746), GC (P02774), Ig heavy chain V-III region TIL (P01765), Ig kappa chain V-III region NG9 (Fragment) (P01621), Ig heavy chain V-III region BUT (P01767), Ig heavy chain V-III region TUR (P01779), C9 (P02748), SERPIND1 (P05546), Ig kappa chain V-I region WEA (P01610), Ig kappa chain V-I region Ni (P01613), Ig kappa chain V-IV region Len (P01625), Ig kappa chain V-I region EU (P01598), Ig kappa chain V-II region TEW (P01617), Ig heavy chain V-III region GAL (P01781), KNG1 (P01042), VTN (P04004), C8B (P07358), Ig lambda chain V-III region LOI (P80748), Ig heavy chain V-II region NEWM (P01825), APCS (P02743), KLKB1 (P03952), CFI (P05156), PROS1 (P07225), LPA (P08519), KRT9 (P35527), SERPINA1 (P01009), Ig lambda chain V-III region SH (P01714), C8A (P07357), Ig kappa chain V-III region B6 (P01619), Ig lambda chain V-IV region Hil (P01717), Ig kappa chain V-III region CLL (P04207), C1S (P09871), FCN3 (O75636), SERPINC1 (P01008), Ig kappa chain V-I region Mev (P01612), IGHD (P01880), C1QC (P02747), HPX (P02790), C8G (P07360), IGKV1-5 (P01602), Ig kappa chain V-I region Wes (P01611), Ig heavy chain V-III region WEA (P01763), A1BG (P04217), GSN (P06396), FBLN1 (P23142), HBB (P68871), ITIH3 (Q06033), F12 (P00748), SERPINA3 (P01011), APOC3 (P02656), Ig kappa chain V-I region BAN (P04430), Ig kappa chain V-III region VH (Fragment) (P04434), F13B (P05160), IGKV4-1 (P06312), SERPINF2 (P08697), CLU (P10909), HIST1H1D (P16402), PON1 (P27169), IGJ (P01591), Ig kappa chain V-III region POM (P01624), Ig heavy chain V-III region CAM (P01768), Ig heavy chain V-III region BUR (P01773), Ig kappa chain V-III region VG (Fragment) (P04433), APOD (P05090), Ig lambda chain V-IV region MOL (P06889), Ig heavy chain V-III region GAR (P80419), FCGBP (Q9Y6R7), APOM (O95445), F13A1 (P00488), Ig heavy chain V-I region HG3 (P01743), C1QA (P02745), Ig lambda chain V-VI region WLT (P06318), C2 (P06681), C4BPB (P20851), CFP (P27918), SERPINA4 (P29622), SAA4 (P35542), SERPINF1 (P36955), LGALS3BP (Q08380), HABP2 (Q14520), RCBTB1 (Q8NDN9), APOL1 (O14791), KCNQ2 (O43526), F9 (P00740), Ig heavy chain V-III region TRO (P01762), Ig heavy chain V-III region HIL (P01771), Ig heavy chain V-II region OU (P01814), APOA2 (P02652), F11 (P03951), Ig lambda chain V-I region WAH (P04208), Ig lambda chain V region 4A (P04211), Ig kappa chain V-II region RPMI 6410 (P06310), Ig kappa chain V-III region IARC/BL41 (P06311), KRT5 (P13647), IGLL1 (P15814), Ig heavy chain V-I region V35 (P23083), HBA1 (P69905), ADIPOQ (Q15848), PGLYRP2 (Q96PD5), UPF3A (Q9H1J1), BCO1 (Q9HAY6), ARFGAP3 (Q9NP61), SARDH (Q9UL12), SERPINA1 (P01009), KNG1 (P01042), Ig kappa chain V-I region Kue (P01604), Ig kappa chain V-I region Lay (P01605), Ig kappa chain V-I region OU (P01606), Ig kappa chain V-II region MIL (P01616), Ig heavy chain V-III region VH26 (P01764), Ig heavy chain V-III region GA (P01769), FN1 (P027510), TTR (P02766), SERPING1 (P05155), APOA4 (P06727), PRSS1 (P07477), ANXA6 (P08133), CFTR (P13569), LBP (P18428), FBLN1 (P23142), SPAG17 (Q6Q759), PDLIM2 (Q96JY6), ARHGEF17 (Q96PE2), IGLC7 (A0M8Q6), AGRN (O00468), AGT (P01019), RBP4 (P02753), AHSG (P02765), Ig kappa chain V-III region GOL (P04206), SERPINA5 (P05154), GSN (P06396), Ig kappa chain V-III region HAH (P18135), CFHR2 (P36980), GIT2 (Q141611), INCENP (Q9NQS7 |
| Non-cancer | Unenriched | LYZ (P00698), IGHG1 (P01857), KRT14 (P02533), KRT6A (P02538), APOA1 (P02647), FGA (P02671), ALB (P02768), HSPB1 (P04792), COL1A2 (P08123), KRT16 (P08779), IGLC6 (P0CF74), KRT5 (P13647), DSP (P15924), DSP (P15924), LGALS7 (P47929), ACTG2 (P63267), DCD (P81605), DSG1 (Q02413), FLG2 (Q5D862), SBSN (Q6UWP8), KRT73 (Q86Y46), HRNR (Q86YZ3), KRT78 (Q8N1N4), SHROOM3 (Q8TF72), TREX2 (Q9BQ50), SPATA7 (Q9P0W8) |
| Cancer | Non-SBED | MUC5B (Q9HC84), FABP5 (Q01469), HPX (P02790), CP (P00450), SPRR2E (P22531), SPRR2D (P22532), PDE4D (Q08499-7), GC (P02774-2), CPD (O75976), CD14 (P08571), LAP3 (P28838-2), AFM (P43652), FCN2 (Q15485-2), DMBT1 (Q9UGM3-9), LIFR (P42702), SNX27 (Q96L92-3), LCN1 (P31025), ARFIP1 (P53367-2), APOH (P02749), KLKB1 (P03952), XP32 (Q5T750), H2AFV (Q71UI9-5), KRT75 (O95678), KRT6C (P48668), KRT83 (P78385), KRT76 (Q01546), KRT33B (Q14525), KRT72 (Q14CN4-3), KRT31 (Q15323), KRT73 (Q86Y46-2), DSG1 (Q02413-2), LCE1C (Q5T751), LCE1A (Q5T7P2), CFB (P00751), CFH (P08603), SERPINA1 (P01009-2), Ig kappa chain V-I region EU (P01598), Ig kappa chain V-II region MIL (P01616), Ig lambda chain V-IV region Bau (P01715), Ig heavy chain V-III region GAL (P01781), IGLC6 (P0CF74) and ACTG2 (P63267-2) |
| Cancer | SBED | Probable ubiquitin carboxyl-terminal hydrolase FAF-Y (O00507-1; O00507-2); Homeobox protein Hox-C12 (P31275); putative uncharacterized protein C18orf65 (Q6ZTR6); Piwi-like protein 2 (Q8TC59-2; Q8TC59-1); Probable ubiquitin carboxyl-terminal hydrolase FAF-X (Q93008-1; Q93008-3); Histone-lysine N-methyltransferase ASH1L (Q9NR48; Q9NR48-2); PNMA-like protein 2 (Q9ULN7-5) |

The biomarkers in this Example can be used to detect microvesicles that are indicative of cancer or non-cancer samples.

Example 24: Identification of Biomarkers Through Affinity Enrichment with an Enriched Oligonucleotide Library and Mass Spectrometry This Example continues upon the Example above. Identification of protein-protein and nucleic acid-protein complexes by affinity purification mass spectrometry (AP-MS) can be hampered in samples comprising complex mixtures of biological components (e.g., bodily fluids including without limitation blood and derivatives thereof). For example, it may be desirable to detect low abundance protein and nucleic acid-protein complexes in a complex milieu comprising various components that may interact promiscuously with specific binding sites such as high abundance proteins that interact non-specifically with the affinity resin. AP-MS has been used previously to enrich for pre-identified targets of interest using individual DNA or RNA aptamers or specific nucleic acid binding domains. In this Example, an enriched oligonucleotide probing library was used as the affinity reagent. This approach combined with mass spectrometry enables the identification of differentially expressed biomarker from different disease states or cellular perturbations without relying on a priori knowledge of the targets of interest. Such biomarker may comprise proteins, nucleic acids, miRNA, mRNA, carbohydrates, lipid targets, combinations thereof, or other components in a biological system.

The method comprises identification of an enriched oligonucleotide probe library according to the methods of the invention followed by target identification with affinity purification of the bound probing library and mass spectrometry. The members of the enriched oligonucleotide probing library comprise an affinity tag. A biological sample is probed with the oligonucleotide probe library, affinity purification of the oligonucleotide probe library via the affinity tag is performed which will accordingly purify biological entities in complex with various members of the probe library, and read-out of targets that purified with the members of the probe library is performed using liquid chromatography-tandem mass spectrometry (LC-MS/MS) for proteins or oligonucleotide targets (e.g., miRNA or mRNA) with next generation sequencing (NGS). Confirmation of protein targets is performed using quantitative mass spectrometry (MS), e.g., using MRM/SRM or SWATH based methods.

The method of the Example lends itself to various options. For example, any appropriate affinity tags can be used for affinity pull-down, including without limitation anti-sense oligonucleotides, biotin, polyhistidine, FLAG octapeptide (i.e., N-DYKDDDDK-C (SEQ ID NO. 134), where N stands for Amino-terminus and C stands for Carboxy terminus), 3X FLAG, Human influenza hemagglutinin (HA)-tag (i.e., N-YPYDVPDYA-C (SEQ ID NO. 135)), myc-tag (N-EQKLISEEDL-C (SEQ ID NO. 136)), other such as known in the art, and combinations thereof. Similarly, any appropriate enrichment support can be used in addition to the magnetic streptavidin beads exemplified herein, including without limitation other bead systems, agarose beads, planar arrays or column chromatography supports. It follows that the various supports can be coupled with the various affinity reagents appropriate for the oligonucleotide library, including without limitation streptavidin, avidin, anti-His tag antibodies, nickel, and the like. The different affinity tags and supports can be combined as desired. This Example used cross-linking but in certain cases such cross-linking is not necessary and may even be undesirable, e.g., to favor identification of high affinity complex formation. When cross-linking is desired, any appropriate cross-linkers can be used to carry out the invention, including BS2G, DSS, formaldehyde, and the like. Other appropriate cross-linkers and methods are described herein. See, e.g., Section "Aptamer Target Identification." Lysis buffers and wash stringencies can be varied, e.g., depending on whether complexes are cross-linked or not. Less stringent lysis/wash conditions may produce a wider array of potential protein complexes of interest whereas more stringent lysis/wash conditions may favor higher affinity oligo-target complexes and/or targets comprising specific proteins (e.g., by disassociating larger complexes bound to the oligos). One of skill will further appreciate that qualitative and/or quantitative LC-MS/MS may be used for target detection and verification. Similarly, metabolic labeling and label-free approaches may be used for quantitative MS, including without limitation spectral counting, SILAC, dimethyl labeling, TMT labeling, Targeted MS with SRM/MRM or SWATH, and the like.

REFERENCES

Vickenborg et al. "Aptamer based affinity labeling of proteins", Angew Chem Int. 51(36):9176-80 (2012).

Tacheny, M, Arnould, T., Renard, A. "Mass spectrometry-based identification of proteins interacting with nucleic acids", Journal of Proteomics 94; 89-109 (2013).

Faoro C and Ataide SF. "Ribonomic approaches to study the RNA-binding proteome.", FEBS Lett. 588(20):3649-64 (2014).

Budayeva H G, Cristea, I M, "A mass spectrometry view of stable and transient protein inteeractions." Adv Exp Med Biol. 806:263-82 (2014).

Example 25: Protocol for Affinity Capture Using Oligonucleotide Probing Library This Example presents a detailed protocol for the method of affinity capture using an oligonucleotide probing library presented in the Example above.

Protocol:

The oligonucleotide probe library comprises F-TRin-35n-B-8-3s described herein either desthiobiotin labeled or unlabeled library and binding to normal (i.e., non-cancer) female plasma. The oligonucleotide probe library is enriched against the plasma samples as described elsewhere (e.g., in Example 21). The plasma samples are processed separately against the desthiobiotin labeled or unlabeled oligonucleotide libraries. General parameters included the following:

48 normal plasma samples are pooled for enrichment of each oligonucleotide library (Desthiobiotin or Unlabeled)

200 µl input plasma per sample

Ultracentrifugation (UC) is used to pre-clear the samples 5 ng of each aptamer library is added to each sample Binding competitors for all library samples include 0.01× S1 (dextran sulfate), 340 ng for tRNA and 340 ng Salmon sperm DNA as described elsewhere herein 6% PEG 8000 is used for precipitation of microvesicles within the samples Affinity purification is performed with C1 Streptavidin beads (MyOne Strptavidin Beads C1-65001, lot 2 ml (10 mg/ml))

Buffers:

Plasma dilution: 6 mM MgCl2 in 2×PBS

Pellet Wash Buffer: 1×PBS, 3 mM MgCl2

PEG Ppt Buffer: 20% Peg8000 in 1×PBS, 3 mM MgCl2

Bead Prep Buffer: 1×PBS containing 0.01% Triton X-100

Lysis Buffer: prepare a 2× stock solution consisting of 100 mM Tris-HCl, 20 mM MgCl2, 400 mM NaCl, 1% Triton X-100, 10% glycerol, pH 7.5. Diluted to 1× with water 1:1 prior to using.

AP Wash buffer 1: 10 mM Tris-HCl, 1 mM EDTA, 2M NaCl, 1% Triton X-100, pH 7.5

AP wash buffer 2: 10 mM Tris-HCL, 1 mM EDTA, 2M NaCl, 0.01% Triton X-100, pH 7.5

Biotin Elution buffer 1: 5 mM Biotin, 20 mM Tris, 50 mM NaCl, pH 7.5

1×LDS, 1× Reducing buffer 2

Reagent/Instrument Prep:

Pre-chill Ultracentrifuge to 4° C.

Protease inhibition: dissolve 2 tablets of "cOmplete ULTRA MINI EDTA-free EASYpack" protease inhibitor in 1100 µl of H2O (20× stock of protease inhibitor).

Plasma Preparation (for Each of Desthiobiotin or Unlabeled Oligonucleotide Libraries):

1. Add 50 µl of protease inhibitor to each ml of sample (on top of frozen plasma) in a room temperature (RT) water bath. Will use 22 mls of pooled plasma, so 1100 µl inhibitor.
2. To remove cell/debris, spin samples at 7500×g 20 min, 4° C. in the Ultracentrifuge.
3. Collect the supernatant, pool and measure volume & record.
4. Add an equal volume of 2×PBS, 6 mM MgCl$_2$ to the plasma.
5. Label low-retention eppendorf tubes 1-96.
6. Transfer 400 µl of each sample to eppendorf tubes based on appropriate tube map
7. Using an electronic P200, add competitors: 8.6 µl of 40 ng/µl Salmon sperm DNA; 8.6 µl of 40 ng/µl tRNA; 8.6 µl of 0.5× S1.
8. Incubate at RT with end over end rotation for 10 min.
9. Add 10 µL of appropriate oligo library, mix well. Save any leftover diluted library for gel control (see below).
10. Incubate 1 hr at RT with end over end rotation.
11. Using an electronic repeat P100, add 187 µl of 20% PEG 8000 to sample for a final 6% concentration to the 435.5 µl of sample/oligo library. Invert a few times to mix and incubate for 15 min at 4° C.
12. Spin each sample in table top centrifuge at 10,000×g for 5 min.
13. Remove supernatant and discard, add 1 ml 1×PBS, 3 mM MgCl$_2$ to pellet.
14. Wash pellet by gentle inversion
15. Remove buffer, re-suspend pellets in 100 µl 1×PBS, 3 mM MgCl$_2$: incubate at RT for 10 min on mixmate @900 rpm to re-suspend. Make sure each sample is well re-suspended by pipetting.
16. Pool all desthiobiotin library samples into one 50 ml falcon tube, and the unlabeled library into another, total volume for each should be 4800 µl.
17. Take 10 µL aliquot for the input into AP sample for gel (add 10 µL of 2×LDS buffer w/2× reducing agent.

Affinity Purification:

18. Prepare 10 µL of MyOne Strep-coated Magnetic beads per each condition into a 1.5 ml eppendorf tube and place on a magnetic bead rack. Have a Bead only control as well (n=3)
19. Remove supernatant and wash 1× 500 µl with Bead buffer.
20. Discard supernatant
21. Resuspend beads in an equal volume of 1×PBS, 3 mM MgCl$_2$ (equal vol to what was taken out originally=10 µl)
22. Add the 10 µl of beads directly to the 4780 µL from step 19. To Bead only control add PBS.
23. Incubate samples with streptavidin beads 1 hr RT on plate shaker (taped).
24. Place on the large magnetic stand for 1 min and remove supernatant
25. Add 1.5 mL of 1× lysis buffer to the samples (do 3× 500 µl with a good rinse of the 50 mL falcon tube for each to collect all the beads) and transfer to a new set of eppendorf tubes.
26. Incubate for 20 min on ice.
27. Place tubes in magnetic bead rack, let equilibrate 1 min and remove the supernatant.
28. Wash the beads with wash buffer #1 via vortexing. Resuspend well.
29. Place tubes on magnetic bead rack, let equilibrate 1 min and remove the supernatant
30. Wash 2 additional times as with wash buffer #1 steps 27-29 (total 3 washes with wash buffer #1)
31. Repeat steps 27-29 (2) additional times with wash buffer #2
32. During the last wash transfer beads to a new eppendorf tube. (to reduce non-specific binding)
33. Do one dry spin to make sure all residual wash buffer is removed.
34. Add 10 µl of Biotin Elution buffer 1 to beads
35. Incubate for 15 minutes at 37° C.
36. Place on magnetic stand for 1 min, collect sup and transfer to a new tube, add 10 µL of 2×LDS, 2× Reducing agent to eluted sample. Save as Elution #1.
37. Add 10 µl of 1×LDS Sample Buffer, 1× Reducing buffer to magnetic beads.
38. Boil the samples for 15 min at 90° C. The boiling time is 15 minutes to ensure the streptavidin on the beads unfolds and releases the biotinylated aptamer-protein complex.
39. Place samples on magnetic stand on ice and collect the eluted sample. This is Elution #2. Discard the beads.
40. Gel 1 layout:

Lane 1: 5 ng Desthiobiotin library
Lane 2: 1×LDS
Lane 3: Marker
Lane 4: Desthiobiotin Elution #1
Lane 5: Unlabeled Elution #1
Lane 6: Bead only Elution #1
Lane 7: Desthiobiotin Elution #2
Lane 8: Unlabeled Elution #2
Lane 9: Bead only Elution #2
Lane 10: Input for AP (saved from step 17)

Running Reducing SDS Gel:

Prepare 1×MOPS SDS Running Buffer from 20×MOPS SDS Buffer

Use 10 or 12 well 4-12% Bis Tris gel

Peel off tape seal and place in the gel box. Insert spacer for second gel cassette if needed Fill the inside/upper chamber with running buffer MOPS (1×) and 500 ul Antioxidant Remove the comb carefully, not disturbing the wells Rinse the wells with the running buffer to remove the storage buffer which can interfere with sample running Slowly load samples to each well carefully using L-20 tip Fill the outer/lower chamber with approximately 600 ml of running buffer MOPS (1×)

Place top portion of unit and secure correct electrodes

Run the gel to migrate proteins

100 V constant for samples to move through stack (until all samples line up) for 15 min Increase to 150 V constant for running (until visible sample buffer comes to bottom) for ~1 hr At the end of the run, stop the power supply and remove the gel cassettes from cell Disassemble the gel cassette by with gel knife.

Remove one side of cassette case. Trim off the gel foot and wells (avoid drying gel).

Transfer gel into container filled with Mili Q water and perform a quick wash.

Silver Staining:

Materials:

ProteoSilver TMSilver Stain Kit, Sigma Catalog No. PROT-SIL1, Lot No. SLBJ0252V

Ethanol, Fisher Scientific Catalog No. BP2818-4, Lot No. 142224

Acetic acid, Acros organics Catalog No. 14893-0025, Lot No. B0520036

Water, Sigma Catalog No. W4502, Lot No. RNBD1581

Preparation:

1. Fixing solution. Add 50 ml of ethanol and 10 ml of acetic acid to 40 ml of ultrapure water.

2. 30% Ethanol solution. Add 30 ml of ethanol to 70 ml of ultrapure water.

3. Sensitizer solution. Add 1 ml of ProteoSilver Sensitizer to 99 ml of ultrapure water. The prepared solution should be used within 2 hours. A precipitate may form in the Proteo-Silver Sensitizer. This precipitate will not affect the performance of the solution. Simply allow the precipitate to settle and remove 1 ml of the supernatant.

4. Silver solution. Add 1 ml of ProteoSilver Silver Solution to 99 ml of ultrapure water. The prepared solution should be used within 2 hours.

5. Developer solution. Add 5 ml ProteoSilver Developer 1 and 0.1 ml ProteoSilver Developer 2 to 95 ml of ultrapure water. The developer solution should be prepared immediately (<20 minutes) before use.

6. All steps should be carried out in the hood and waste needs to be collected in toxic designated container.

Procedure

A. Direct Silver Staining

All steps are carried out at room temperature on an orbital shaker at 60 to 70 rpm.

1. Fixing—After electrophoresis of the proteins in the mini polyacrylamide gel, place the gel into a clean tray with 100 ml of the Fixing solution overnight in the hood. Cover tightly.

2. Ethanol wash—Decant the Fixing solution and wash the gel for 10 minutes with 100 ml of the 30% Ethanol solution.

3. Water wash—Decant the 30% Ethanol solution and wash the gel for 10 minutes with 200 ml of ultrapure water.

4. Sensitization—Decant the water and incubate the gel for 10 minutes with 100 ml of the Sensitizer solution.

5. Water wash—Decant the Sensitizer solution and wash the gel twice, each time for 10 minutes with 200 ml of ultrapure water.

7. Silver equilibration—Decant the water and equilibrate the gel for 10 minutes with 100 ml of the Silver solution.

8. Water wash—Decant the Silver solution and wash the gel for 1 to 1.5 minutes with 200 ml of ultrapure water.

9. Gel development—Decant the water and develop the gel with 100 ml of the Developer solution. Development times of 3 to 7 minutes are sufficient to produce the desired staining intensity for most gels. Development times as long as 10 to 12 minutes may be required to detect bands or spots with very low protein concentrations (0.1 ng/mm2).

10. Stop—Add 5 ml of the ProteoSilver Stop Solution to the developer solution to stop the developing reaction and incubate for 5 minutes. Bubbles of $CO_2$ gas will form in the mixture.

11. Storage—Decant the Developer/Stop solution and wash the gel for 15 minutes with 200 ml of ultrapure water. Store the gel in fresh, ultrapure water and take picture for documentation.

Protein identification

Protein bands of interest were excised from the gradient gels and subjected to liquid chromatography-tandem mass spectrometry (LC-MS/MS) as above.

Example 26: Oligonucleotide Probes: Breast Cancer Versus Non-Cancer

This Example presents breast cancer oligonucleotide probes identified in a library enriched against balanced fractions pool of plasma-derived microvesicles from patients with 50% aggressive cancer. General methodology is as presented in Example 21 above. The samples comprised pools of 30 each of breast cancer patient plasma and healthy plasma (i.e., non-cancer controls). A set of cancer specific aptamers was identified where each aptamer has a fold change exceeding two when compared to either the healthy plasma pool (normal and non-cancer) or process control (no negative selection enriched library).

Methodology

The F-TRin-35n-B 8-3s library as described herein was enriched against microvesicles from the plasma samples. See Example 21 with the modifications noted below. The screened library comprised a 5' region (5' CTAGCATGACT-GCAGTACGT 3' (SEQ ID NO. 131)) followed by the random naïve aptamer sequences and a 3' region (5' CTGTCTCTTATACACATCTGACGCTGCCGACGA (SEQ ID NO. 132)). In the previous enrichment protocol in Example 21, positive, negative and positive selections were performed before each cycle of PCR to re-amplify the library. But in the current enrichment protocol, the aptamer library was purified with streptavidin beads after each selection and the beads were directly used for PCR amplification. Also as compared to prior experiments, the new sample pool for aptamer enrichment was balanced for different plasma fractions and collection vial for each of cancer, non-cancer and normal patients. Specifically, plasma was initially collected in 4 tubes from each patient, each of those 4 tubes were split into 3 aliquots, resulting in 12 aliquots from each patient. For example, a 1st tube out of the 4 results in aliquots 1A, 1B and 1C, the same split is repeated for the other three aliquots, which results in 12 aliquots from each patient (1A-C, 2A-C, 3A-C, 4A-C). Correspondingly, a pool of 60 patients consists of each variant repeated 5 times (5×12). Enrichment was done according to the selection methodology outlined above, where the library was PCR amplified after each binding round for 7 rounds, which include 3 positive selections against cancer-derived samples, 3 negative selections against controls, and a final positive selection. The enriched library was subjected to the probing test on cancer and healthy pools of plasma samples. There was a subset of 296 cancer specific aptamers, which have a relatively higher read count and fold change >2 as compared to healthy pool and process control. The detailed protocol is as follows:

Equipment & Supplies

1×PBS (HiClone): SH30256.01, Lot #: AZC186921, bottle #1476, exp. 05/2016. Supplemented with 3 mM $MgCl_2$ (4227844, USB) in steps 6, 7, 11.

Table Top centrifuge: 0363
20× S1: Aptamer Science TT 070214, LN: 14F-01-S1, exp. 2015-06
PEG8000— lot #SLBJ9928V cat #91458, protease inhibitor Ref—05892791, Water—ref 10977-015, lot #1606173
2×PBS+ 6 mM $MgCl_2$—PBS (Sigma)—SLBK2636V, Water—RNBD2918, $MgCl_2$-4227844 (USB). Used in steps: 5, 9.
Stock yeast tRNA (Ambion)—lot #1406019. Salmon DNA (Invitrogen)—lot #1617974
Starting solution comprises 5 ng Non-Enriched F-Trin-35n-B aptamer library, 300 ul of plasma, 0.01× S1+0.8 ng/ul Salmon DNA/tRNA (competitor DNAs), 6% PEG8000 (to precipitate microvesicles); final volume 600 ul.

Round 1 (1st positive enrichment)

Step 1: Pre-chill tabletop centrifuge at 4° C.

Step 2: Protease inhibition: dissolve 1 tablet of "cOmplete ULTRA MINI EDTA-free EASYpack" protease inhibitor in 550 ul of H2O (20× stock of protease inhibitor).

Step 3: Add 50 ul of protease inhibitor to the sample (on top of frozen plasma) and start thawing: 1 ml total ea.

Step 4: Cell spin: To remove cells/debris, spin samples at 10,000×g, 20 min, 4° C. Collect the entire volume of supernatant (SN) without disturbing the pellet.

Step 5: Mix SN from step 4 with equal volume of 2×PBS 6 mM $MgCl_2$, collect 600 ul ea into 2 ml Fisher Low binding tubes for use in step 6. Store remaining sample at 4° C. for the following rounds.

Step 6: Blocking: Add competitors in order: 1) Salmon DNA Stock; 2) tRNA; 3) S1. Make dilutions to desired concentration (see starting solution above) in 1×PBS, 3 mM MgCl2, mix well. Incubate for 10 min at room temperature (RT), end-over-end rotation.

Step 7: Binding: Add ssDNA Probing library to the final concentration 12.5 pg/ul for binding. Make dilutions in 1×PBS, 3 mM $MgCl_2$.

Step 8: Precipitation: Add buffer (20% PEG8000 in 1×PBS with 3 mM $MgCl_2$) to sample to the final PEG concentration 6%.

Step 9: Spin at 10,000×g for 5 min, RT.

Step 10: Wash: Remove SN, add 1 ml 1×PBS, 3 mM MgCl2 and wash pellet by gentle inversion with 1 ml aptamer buffer.

Step 11: Resuspention: Remove buffer, Re-suspend pellets in 200 ul H2O: incubate at RT for 10 min on mixmate 900 rpm. Ensure each sample is re-suspended by pipeting after step 11.

Step 12: Purification: Aptamers elution from PEG/Protein pellet with Streptavidin beads (Dynabeads #65001: Dynabeads® MyOne™ Streptavidin C1):
→Beads stock: 10 mg/ml; Capacity: >2,500 pmoles/mg;
→10 ul beads should bind 250 pmoles Biotin
→3 ul beads for each aptamer library (AL) sample can bind 75 pmoles Biotin
Library input in the protocol above is ~5 ng, which is 0.17 pmol 12.1) Pre-washing Streptavidin Magnetic Beads:

12.1.1 Add 10 uL of Streptavidin Magnetic Beads into 1.5 mL microcentrifuge tube (3 ul×2 samples+overage)

12.1.2 Place the tube into a magnetic stand to collect the beads against the side of the tube. Remove and discard the supernatant.

12.1.3 Add 0.5 mL of Wash Buffer (1×PBS with 0.1% Tween 20) to the tube. Invert the tube several times or vortex gently to mix. Collect the beads with a magnetic stand, then remove and discard the supernatant.

12.1.4 Wash once with 0.5 ml 1×PBS, collect the beads with a magnetic stand, then remove and discard the supernatant.

12.1.5 Add 35 ul 1×PBS to tubes. Aliquot into 10 ul per well (using repeater pipet) in 1.5 ml Fisher low-binding tubes. Add 40 ul of 1×PBS.

12.2) Incubate 100 ul of sample, recovered in step 12, at 50° C. for 10 min (mixmate, 500 rpm) (to denature/remove protein/PEG from aptamer library)

12.3) Sample Binding:

12.3.6 Add heat denatured samples to beads (aliquoted in step 5).

12.3.7 Incubate for 30 min, 37° C., mixmate at 800 rpm. Spin down at 2000 rpm for 20 sec.

12.3.8 Collect the beads (with bound aptamers) using magnet and remove the supernatant by multichannel pipet.

12.3.9 Take tubes off the magnet, add 300 ul of 1×PBS, pipet well. Collect the beads with magnetic stand, then remove supernatant.

12.3.10 Add 100 ul H2O to resuspend beads by multichannel pipet.

12.3.11 Block the beads with Biotin: add 7.5 ul from 10 uM stock, incubate 15 min, RT, 800 rpm.

12.3.12 Collect the beads (with bound aptamers) using magnet and remove the supernatant by multichannel pipet. Take tubes off the magnet, add 200 ul of 1×PBS, pipet well. Collect the beads with magnetic stand, then remove supernatant.

12.3.13 Add 100 ul H2O

Step 13: Use beads with bound aptamer library directly in re-AMP PCR (3×33 ul)

Step 14: Agarose gel
SYBR Gold gel lot #: H204044-01
2 ul of sample+8 ul of loading buffer. Run for 10 cycles
If no dsDNA bands appear, run additional 3 cycles
Optional: if PCR product has non-specific bands, perform gel cut.

Step 15: dsDNA purification with Nucleospin column (NTI binding buffer):
2× volume of buffer NTI per sample volume (600 ul NTI to 300 ul sample)
combine 3 wells per column
5 min elution in 30 ul NE buffer, RT. Add 20 ul of NE after elution.

Step 16: Optional: Gel, SybrGold, Agarose: to verify product with correct size is observed Step 17: Quantify dsDNA (QuBit, Life Technologies) (keep 5 ul of dsDNA as control for gel later)

Step 18: Lambda digestion at 37 C. for 2 h; heat inactivation at 80 C. for 10 min.

Step 19: ssDNA purification with Nucleospin column (NTC binding buffer).
combine 3 samples per column
elution: 5 min in 30 ul NE buffer, RT Step 20: Quantify dsDNA (QuBit, Life Technologies) ssDNA (5 ul)

Step 21: Gel ssDNA: load between 2 ng and 10 ng

Round 2 (2d positive enrichment)

Repeat protocol starting from step 6 above, using diluted plasma samples stored in step 5. All steps are the same except for step 7. Input of library is 5 times less Step 7: Binding: Add ssDNA Probing library to the final concentration 2.5 pg/ul for binding. Make dilutions in 1×PBS, 3 mM MgCl2.

Steps 6-13: As above. Use entire 100 ul of re-suspended sample to re-amplify via PCR Steps 14-20: ssDNA preparation as above.
Round 3 (3rd positive enrichment)
Repeat steps as shown for round 2
Round 4 (Negative enrichment)
Make sure to use correct negative samples (e.g., non-cancer sample in the case of positive cancer selection above, or vice versa)
Steps 1-9: Repeat as in Round 2 above (ssDNA input is 2.5 pg/ul).
Step 10: Collect SN (~900 ul) and discard pellet after PEG precipitation.
Step 11: Resuspention: Not needed in this step
Step 12: Purification: Aptamers elution from PEG/Protein pellet with Streptavidin beads (Dynabeads #65001: Dynabeads® MyOne™ Streptavidin C1):
→Beads stock: 10 mg/ml; Capacity: >2,500 pmoles/mg;
→10 ul beads should bind 250 pmoles Biotin
→3 ul beads for each AL sample can bind 75 pmoles Biotin
Library input in the protocol above is ~5 ng, which is 0.17 pmol
CHANGE FOR SN→For each sample, split 900 ul SN collected in step 10 above into two aliquots 450 ul ea, consider 3 ul of beads per each aliquot.
12.1) Pre-washing Streptavidin Magnetic Beads:
12.1.1 Add 30 uL of Streptavidin Magnetic Beads into 1.5 mL microcentrifuge tube. Four samples make 8 aliquots (for beads treatment)×3 ul beads+overage.
12.1.2 Place the tube into a magnetic stand to collect the beads against the side of the tube. Remove and discard the supernatant.
12.1.3 Add 0.5 mL of Wash Buffer (1×PBS with 0.1% Tween 20) to the tube. Invert the tube several times or vortex gently to mix. Collect the beads with a magnetic stand, then remove and discard the supernatant.
12.1.4 Wash 1 time with 0.5 ml 1×PBS, collect the beads with a magnetic stand, then remove and discard the supernatant.
12.1.5 Add 105 ul 1×PBS to tubes. Aliquot into 10 ul per well (using repeater pipet) in 1.5 ml Fisher low-binding tubes. Add 40 ul of 1×PBS.
12.2) Incubate 900 ul of sample, recovered in step 10, at 50° C. for 10 min (mixmate, 500 rpm) (to denature/remove protein/PEG from aptamer library)
12.3) Sample Binding:
12.3.6 Add 1/2 (450 ul) heat denatured samples to beads (aliquoted in step 5).
12.3.7 Incubate for 30 min, 37° C., end-over-end rotation. Spin down at 2000 rpm for 20 sec.
12.3.8 Collect the beads (with bound aptamers) using magnet and remove the supernatant by multichannel pipet.
12.3.9 Take tubes off the magnet, add 300 ul of 1×PBS, pipet well. Collect the beads with magnetic stand, then remove supernatant.
12.3.10 Add 100 ul H2O to resuspend beads by multichannel pipet.
12.3.11 Block the beads with Biotin: add 7.5 ul from 10 uM stock, incubate 15 min, RT, 800 rpm.
12.3.12 Collect the beads (with bound aptamers) using magnet and remove the supernatant by multichannel pipet. Take tubes off the magnet, add 200 ul of 1×PBS, pipet well. Collect the beads with magnetic stand, then remove supernatant.
12.3.13 Add 100 ul H2O per purification sample (total 200 ul per negative enrichment sample)
12.3.14 Split each sample into 3 aliquots (33 ul each), this results into 6 wells per enrichment sample.
Step 13: Perform PCR
Rounds 5, 6: same as round 4
Round 7: repeats steps as shown for round 2
Results FIGS. 14A-B are scatter plots showing high correlation of frequencies between replicates of cancer pool (FIG. 14A) and appearance of cancer specific subset of aptamers when cancer and healthy pools are compared (circled region in FIG. 14B). FIGS. 14C-F are scatter plots showing the appearance of cancer specific subset of aptamers when the cancer pool profile of the enriched library (i.e., C-RN7) was compared to the cancer pool of the process control library (CP; FIG. 14C) and healthy pool profile of process control library (HP; FIG. 14D). We did not observe a similar subset when the healthy pool profile (C-RN7 v HP) of the enriched library was compared to both variants of profile of process control (FIGS. 14E-F, see points along x-axis).

Selections of aptamer sequences identified in the enrichment screening are shown in Tables 27-29. In these tables, each complete aptamer sequence is assembled from 5' to 3' as a 5' region, the variable region, and 3' region. The sequences are shown 5' to 3' from left to right, wherein each complete sequence consists of a 5' leader sequence 5'-CTAGCATGACTGCAGTACGT (SEQ ID NO. 131) followed by the indicated Variable Region sequence followed by the 3' tail sequence 5'-CTGTCTCTTATACACATCT-GACGCTGCCGACGA (SEQ ID NO. 132). The top 50 cancer specific sequences are shown in Table 27, each having a relatively high copy number in these experiments and a cancer/normal copy number ratio of at least 2-fold higher in the cancers. Table 28 comprises 25 sequences with mid-level copy number and a cancer/normal copy number difference of 0.8-1.2-fold. Table 29 shows a selection of 25 more sequences with low copy numbers and cancer/normal copy number ratio of ~1.0 (i.e., no significant difference).

TABLE 27

Cancer-Specific Sequences

| SEQ ID NO. | Variable Region |
| --- | --- |
| 137 | AACCCGCGTGATTGGGGTACTGCCCATGCGACTTT |
| 138 | AACTGAAGGCCAATTAAACTCCACTGTGCTAATCT |
| 139 | ACATGCCGGCGTTGATACTCTACTGTGCTCCATTATGA |
| 140 | AGACATGCCACGCCCTTTACATACTCCACTGTGCCA |
| 141 | AGCCACGCAGACCTATCTCTACTGTGCCAATGTT |
| 142 | AGGTACGTAAGGCTGCCATTACTCTCTACTGTGCCGA |
| 143 | AGTCTAGCGATCGACTTTTCTCTACGGTGCCCTTC |
| 144 | AGTGTGCGCATGAATCCATTACTCCACTGTGCCTTGA |
| 145 | AGTTGCAGACCCTTGTATTCTCTACCGTGCCCTATGA |
| 146 | CACTGCTAACTGATATTGTTGAACTCCACCGTGC |
| 147 | CATGCGACAAGCTTCCATTAACCATCCGCTATTTATGA |
| 148 | CATGCGGACCACGCTTTCACAAACTCATGATTCAAA |
| 149 | CATGCGTACGTCCTATTCTCTCTACTGTGCATTAA |
| 150 | CCTGCAATGCGGAAACCCTTCTACTCTACTGTGCC |

TABLE 27-continued

Cancer-Specific Sequences

| SEQ ID NO. | Variable Region |
|---|---|
| 151 | CGCGAGCCAGGGTACTGCCTGCGGTCTAAACAATCA |
| 152 | CGTGCGACTTGTTCTCTACTGTGCCAATAAACCATA |
| 153 | GATAGCGCATATTCCTCTACTGTGCTACTTGTTAT |
| 154 | GCAAACCAATTAGTGTACCTCTACCGTGCCCAATGA |
| 155 | GCAACTACTCTCTACCGTGCCCAGTGATTTCTCCATGA |
| 156 | GCACCACATGTCAATCTCTACTGTGCTTATCTCATA |
| 157 | GCAGCACAAAAGTTACTCTCCTCTACCGTGCCCCTA |
| 158 | GCAGTTTGCGTGGATACTCTACTGTGCTGACCCTTA |
| 159 | GCATACATGAACTCTACCGTGCCCGTTGACTTGAAA |
| 160 | GCATAGCGGTTCACATTATTTTACTCTACCGTGCC |
| 161 | GCCACAGTATCGTTCTCGAGCTGGTTCCCGCCAT |
| 162 | GCGAACATCACTCTACCGTGCCATCTGAAATGACGTGA |
| 163 | GCGAACTTGTAACTCTACTGTGCTTATATTAAGGTTGA |
| 164 | GCGACCAATACTCTACTGTGCTGATACGGATTTTA |
| 165 | GCGACCACTCTATAACCTCAACCGTGCTCACTCCT |
| 166 | GCGCAAGTTGTCTCTACCGTGCCCCGAAAGTTTTGGA |
| 167 | GCGCACCACCTACATTGTCTCCACCGTGCTTTATT |
| 168 | GCGCACCCACGTGAACTCTACCGTGCCTATTTCCTA |
| 169 | GCGCACCGACCTCTACCGTGCCAAAATAGGTTATCTGA |
| 170 | GCGCCACCACACAAACCTTCCCTATCGAGGGAGAT |
| 171 | GCGCGGACTATATTACTCTACTGTGCCCTGCTTATGA |
| 172 | GCGGATAGGACAATAACTTACTCCACTGTGCCATC |
| 173 | GCGGTGACCTCTACTGTGCGCCCCAAGCCTTAGTT |
| 174 | GCGTACAGAACCTCTACCGTGCCCACTCACTTCCATGA |
| 175 | GCGTCCCCTCCCGGATGGTCCTTTCTCTACTGTGC |
| 176 | GCGTGCTAACGGTATGCAAGACGTATGCGATTTTC |
| 177 | GCTAGACCGATCCACCTCAAACCTCTACTGTGCCT |
| 178 | GCTAGCTTAGCTCTACCGTGCACATTCCGCTATTT |
| 179 | GGTGCAGGCAAGATATTTTACTCTACTGTGCATTT |
| 180 | GTAAATGTACATGCGTATCCTCACCTCTACTGTGC |
| 181 | TAACACGTCTTTCACTCTACTGTGCCCTTTATGCC |
| 182 | TAATGGCATGCGGACCTATCCTCTACCGTGCTCCTTGA |
| 183 | TATGCGATTTCTCTACCGTGCCAATATGCCTTGTT |
| 184 | TCTGCGATTCTACCGTTACTCTACCGTGCCACCAAA |
| 185 | TGCGCAGTCATTTCGCCATGTTCTCTACCGTGCCAA |
| 186 | TGTCAGGCGGTAGTACTCTCCACCGTGCCTATTGTTGA |

TABLE 28

Moderate Control Sequences

| SEQ ID NO. | Variable Region |
|---|---|
| 187 | ACATGCATACCCTACGAATCGTTCCATCACCATAC |
| 188 | AGTCAGTGCGCCCGCTATTTACGATCTCACTGTTC |
| 189 | AGTGCAGTCGCGATGGAACTTCTTCTTTGCTTTA |
| 190 | ATGGCCATGCGAACCGAAACCTAGCCCATTTTCCTA |
| 191 | ATTGCGGTCATCCCCTTCCACGCTATACCACCAT |
| 192 | CACTGCAGGTCACTGGCGCCCTATTTCCTCACATT |
| 193 | CATGCCCGTAAACGCCTAATCTACCACCTTTTGCT |
| 194 | CATGCCGCCTTTCGACTTCCATATCCCAACACGCC |
| 195 | CATGCCGGTCATTCCATACTCAAACTCATTCACTC |
| 196 | CATGCGAGCTACCCTTATCATCTCATGTTTGCTTT |
| 197 | CATGCGATTGCGCCCCATTCCTTGCCTTATCTCAC |
| 198 | CATGCGCACATCGTACTCCGTAGCCCTAAATTATCA |
| 199 | CATGCGCCCTGTGCGTTCTCTACTACCCTAATCAT |
| 200 | CATGTACGCACACCCACTGATTCTTTACCACCCACTGA |
| 201 | GCAGGACACCCCCTCATTATTTGTTTCATCCTACG |
| 202 | GCATCAGGCGCACTTTCATTTGCTAATCGTTTTTT |
| 203 | GCCATGCGAGAGGGTTATTGTTGATCTCATGGGTT |
| 204 | GCGATAAAGCCCATGTAACCCTCTGAAAACCCGAT |
| 205 | GCGCCACGAGCTACCCGACTTCCGATTACTTTCTT |
| 206 | GCGGACATCGGGCACTTTATACAACCACCTTTTTG |
| 207 | GCTGCAGGCCGTCCCAAATATTCGCTCCCACACATA |
| 208 | GCTGGTCAGGCGTTCCACACTTCCTACCCGCTTTT |
| 209 | TATGCGCAGGACCACCTATTACACGACCTTATCCT |
| 210 | TCAACTGGGGTCAGTGCCAACGCTTACTTTCTTCT |
| 211 | TCAAGCAGTCATAGCCGGTTTCACGCTTTACTTAC |

TABLE 29

Negative Control Sequences

| SEQ ID NO. | Variable Region |
|---|---|
| 212 | AAAACACGCAAACTACCTGGAAACTTGACTTCTTT |
| 213 | AAAACACTCACGATACCTACCCTGGTCTTCACAAC |
| 214 | AAAACAGCAGGCATTTCCTGTACTTTCGAATTCA |
| 215 | AAAACCACAGCTACCATTATCGCATTGGCCCTACT |
| 216 | AAAACCCAAGCACCGAACGAACTATCCCTTTTTCT |
| 217 | AAAACCCACCACGCGTCGTACGCATACCACCCTTT |
| 218 | AAAACCGGTCCTGCGCCTTCTTCTCCGCTTTTATT |
| 219 | CAGGTACTGTGGCAGGCGATCCATTGCTCTCTTTT |

TABLE 29-continued

Negative Control Sequences

| SEQ ID NO. | Variable Region |
|---|---|
| 220 | CAGGTCAGCAGTCCAGGCGATTACTTTCTCTTTTC |
| 221 | CAGTAACCGCTGTCTGTCATTTTTCAACATTCTGT |
| 222 | CAGTAACTGTAGTCGTCGAACCTTGCTTACAACCCA |
| 223 | CAGTAAGGAAGCTCATGCGGTACAGGTCTACCTCG |
| 224 | CAGTAAGTGCTGTCACTGCGCCACTTGTAAATACTTGA |
| 225 | CAGTAATGCGAAGCTAGTACGTTCTCTCTTATTTTA |
| 226 | CAGTACAAACATCGCGATTCTTTCCTTGATACTGT |
| 227 | GAGGGCGGCTCTAATGCATGCGCTTTCATCTTTGC |
| 228 | GAGGGCGGGCAGTCATTTCGATTATATCTGCCTACA |
| 229 | GAGGGCGGTCCAACGCGCAATGTCTTTTTTCTTCCGA |
| 230 | GAGGGCGTACAGGAGTCTTGCGGTCCACATTTTAT |
| 231 | GAGGGCTACTGAAGTTAATGGCATTCTTCTCTATC |
| 232 | GAGGGCTCATGCCAGCCGCTTTTCTTACCTTTATC |
| 233 | GAGGGCTGAACAAGTAGTGCGTACATTTTCCTTCCTGA |
| 234 | GAGGGCTGCAGGCATCCAATTTCCTCCTTGTCCCT |
| 235 | GAGGGGCCGTCCTTCGTACGGAATGTGCATGCGCT |
| 236 | GAGGGGCGGTCATTGCCGTTAGCCTCCTTTCGCCT |

The data described above (i.e., FIGS. 15A-F and Tables 27-29) were obtained with 1 ng input of the specified oligonucleotide libraries used to probe the various samples. In addition, probing experiments were performed with lower titers of the C-R7N oligonucleotide library, specifically 0.1, 0.01, 0.001 and 0.0001 ng. A total of 826 unique oligonucleotide sequences were detected between all titers. An eighth enrichment round (round 8) was performed with four titers of the library C-R7N-1 (i.e., 1 ng input in round 7): 1, 0.1, 0.01 and 0.001 ng input. From each titer, sets of oligonucleotides that passed the same filters described above were obtained. The composite set of oligonucleotides was compared to the sets of oligonucleotides obtained from the titrations of the C-R7N library noted above. The variable regions of 733 oligonucleotides observed in at least two of the five sets of oligonucleotides are listed in rank order by occurrence in SEQ ID NOs. 237-969. These oligonucleotides were identified as oligonucleotide probes that selectively bind to cancer samples. As in Table 27, the oligonucleotides were synthesized with a 5' region consisting of the sequence (5'-CTAGCATGACTGCAGTACGT (SEQ ID NO. 131)) and a 3' region consisting of the sequence (5'-CTGTCTCTTATACACATCTGACGCTGCCGACGA (SEQ ID NO. 132)) flanking the variable regions. The 733 cancer specific sequences which can be used to identify cancer samples along with those in Table 27 above.

Figure 14G:
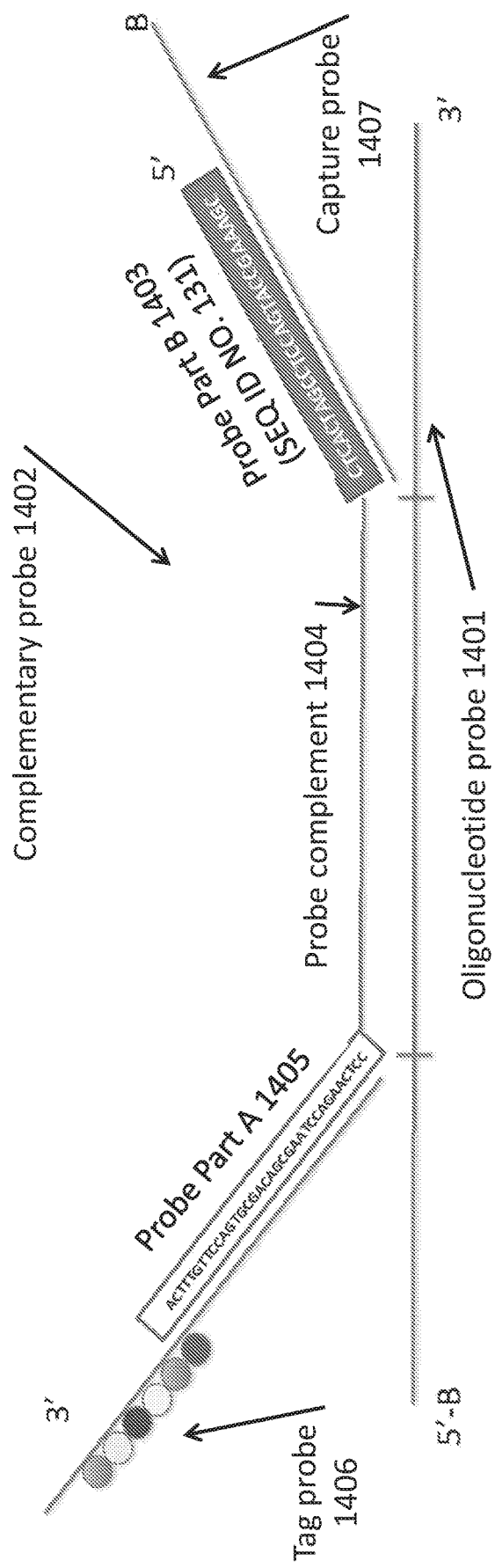

As noted, next generation sequencing technologies can be used to identify and quantify members of the oligonucleotide library that bind to a sample. We also designed probes that can be used to identify and quantify members of the oligonucleotide library that bind to a sample without requiring a PCR step. This procedure relies on hybridization of the bound oligonucleotide with oligonucleotide-specific complementary probe. The complementary probe can directly or indirectly carry a tag that can be detected. For example, the oligonucleotide-specific complementary probe may carry a fluorescent tag. A general design is shown in FIG. 14G. In the figure, an individual member of the oligonucleotide library 1401 is bound by complementary probe 1402. Complementary probe 1402 consists of three sections from 5' to 3':1) probe part B 1403; 2) probe complement 1404; and 3) probe part A 1405. The member of the oligonucleotide library 1401 is bound by complementary probe 1402 via base pair hybridization between the variable region of oligonucleotide library 1401 and the probe complement region 1404 of complementary probe 1402. Tag probe 1406 which is fluorescently labeled (indicated by the circles in the figure) and capture probe 1407 hydridize to the probe part A 1405 and probe part B 1403 of complementary probe 1402, respectively. These features allow for the capture of the entire complex (i.e., oligonucleotide library 1401, complementary probe 1402, tag probe 1406, and capture probe 1407) via the capture probe, combined with detection via the label of the tag probe 1406.

For these experiments, the complementary probes were designed to work with tag probe and capture probe supplied as part of the nCounter nucleic acid detection system from NanoString Technologies, Inc. (Seattle, Wash.). The complementary probes for nCounter quantification were designed as reverse complement to the top 50 oligonucleotide probe binders and 50 negative controls, described above. The complete sequences are shown in Table 30. In the table, the ID column is an identifier and the Type column indicates if the sequence is to a control oligonucleotide probe ("neutral") or to a cancer binding oligonucleotide probe ("binder"). Each complete sequence comprises from 5' to 3': 1) 5' Region (Probe Part B 1403); 2) Probe Complement Region 1404; and 3) 3' Region (Probe Part A 1405), where region indentification numbers correspond to FIG. 14G. The probe complement region may be shorter than the variable sequence of the corresponding oligonucleotide probe in order to optimize binding parameters (e.g., specificity and melting point). The probe complement region may also be so optimized to bind against the variable sequence of the corresponding oligonucleotide probe and also to at least a portion of its 5' and 3' flanking sequences (e.g., as shown in Tables 27-29 above). The oligonucleotides each have a 5' region 1403 consisting of the sequence (5'-CGAAAGCCATGACCTCCGATCACTC (SEQ ID NO. 970)) 5' of the Probe Complement Region 1404 and a 3' region 1405 as shown in Table 30 located 3' of the Probe Complement Region 1404. Probe Part A 1405 shown in FIG. 14G corresponds to SEQ ID NO. 971.

TABLE 30

Complementary Probe Sequences

| SEQ ID NO | Type | Probe Complement Region 1504 | 3' Region (Probe Part A 1505) |
|---|---|---|---|
| 972 | neutral | CAAGTTTCCAGGTAGTTTGCGTGTTTTACGTAC | CCTCAAGACCTAAGCGACAGCGTGACCTTGTTTCA |

TABLE 30-continued

Complementary Probe Sequences

| SEQ ID NO | Type | Probe Complement Region 1504 | 3' Region (Probe Part A 1505) |
|---|---|---|---|
| 973 | neutral | CAGGGTAGGTATCGTGAGTGTTTTACGTACT | CATCCTCTTCTTTTCTTGGTGTTGAGAAGATGCTC |
| 974 | neutral | GAAAGTACAGGAAAATGCCTGCTGTTTTACGTAC | CACAATTCTGCGGGTTAGCAGGAAGGTTAGGGAAC |
| 975 | neutral | GAGACAGAGTAGGGCCAATGCGATAATG | CTGTTGAGATTATTGAGCTTCATCATGACCAGAAG |
| 976 | neutral | GAGACAGAGAAAAAGGGATAGTTCGTTCGGT | CAAAGACGCCTATCTTCCAGTTTGATCGGGAAACT |
| 977 | neutral | GACGCGTGGTGGGTTTTACGTAC | CGAACCTAACTCCTCGCTACATTCCTATTGTTTTC |
| 978 | neutral | GCGCAGGACCGGTTTTACGTAC | CCAATTTGGTTTTACTCCCCTCGATTATGCGGAGT |
| 979 | binder | GAGACAGAAAGTCGCATGGGCAGTA | CTTTCGGGTTATATCTATCATTTACTTGACACCCT |
| 980 | binder | AGTGGAGTTTAATTGGCCTTCAGTTACGTACT | CAACAGCCACTTTTTTTCCAAATTTTGCAAGAGCC |
| 981 | neutral | GAACGATTCGTAGGGTATGCATGTACGTACT | CACCGTGTGGACGGCAACTCAGAGATAACGCATAT |
| 982 | binder | AGTATCAACGCCGGCATGTACGTAC | CCTGGAGTTTATGTATTGCCAACGAGTTTGTCTTT |
| 983 | binder | TAAAGGGCGTGGCATGTCTACGTAC | CAGATAAGGTTGTTATTGTGGAGGATGTTACTACA |
| 984 | binder | GAGACAGAACATTGGCACAGTAGAGATAGGT | CTTCCTTCCTGTGTTCCAGCTACAAACTTAGAAAC |
| 985 | binder | TAATGGCAGCCTTACGTACCTACGTACT | CATAAAATTGGTTTTGCCTTTCAGCAATTCAACTT |
| 986 | neutral | CGGGCGCACTGACTACGTAC | CTGGTCAAGACTTGCATGAGGACCCGCAAATTCCT |
| 987 | binder | GAGACAGGAAGGGCACCGTAGA | CTTTCGTTGGGACGCTTGAAGCGCAAGTAGAAAAC |
| 988 | neutral | CCATCGCGACTGCACTACGTACT | CCAGCAGACCTGCAATATCAAAGTTATAAGCGCGT |
| 989 | binder | GAGACAGTCAAGGCACAGTGGAGTAATG | CCTGCCAATGCACTCGATCTTGTCATTTTTTTGCG |
| 990 | binder | GGTAGAGAATACAAGGGTCTGCAACTACGTAC | CAAACTGGAGAGAGAAGTGAAGACGATTTAACCCA |
| 991 | neutral | CGGTTCGCATGGCCATACGTAC | CGATTGCTGCATTCCGCTCAACGCTTGAGGAAGTA |
| 992 | neutral | GAAGGGGATGACCGCAATACGTACT | CTGAGGCTGTTAAAGCTGTAGCAACTCTTCCACGA |
| 993 | neutral | CCAGTGACCTGCAGTGACGTACT | CTAGGACGCAAATCACTTGAAGAAGTGAAAGCGAG |
| 994 | binder | TGGAGTTCAACAATATCAGTTAGCAGTGACGTAC | CCACGCGATGACGTTCGTCAAGAGTCGCATAATCT |
| 995 | neutral | CCTGCCACAGTACCTGACGTACT | CATTTGGAATGATGTGTACTGGGAATAAGACGACG |
| 996 | neutral | CTGGACTGCTGACCTGACGTACT | CACAAGAATCCCTGCTAGCTGAAGGAGGGTCAAAC |
| 997 | neutral | GAAAAATGACAGACAGCGGTTACTGACGTAC | CTTGACGTAGATTGCTATCAGGTTACGATGACTGC |

TABLE 30-continued

Complementary Probe Sequences

| SEQ ID NO | Type | Probe Complement Region 1504 | 3' Region (Probe Part A 1505) |
|---|---|---|---|
| 998 | neutral | AGGTTCGACGACTACAGTTACTGACGTAC | CTTACAGATCGTGTGCTCATGACTTCCACAGACGT |
| 999 | neutral | CGCATGAGCTTCCTTACTGACGTACT | CTTGGAGGAGTTGATAGTGGTAAAACAACATTAGC |
| 1000 | neutral | GAGACAGTCAAGTATTTACAAGTGGCGCAG | CCTACGTATATATCCAAGTGGTTATGTCCGACGGC |
| 1001 | neutral | GAGACAGTAAAATAAGAGAGAACGTACTAGCTTCGCATTA | CAGCAAGAAGGAGTATGGAACTTATAGCAAGAGAG |
| 1002 | neutral | GGAAAGAATCGCGATGTTTGTACTGACGTAC | CACCCCTCCAAACGCATTCTTATTGGCAAATGGAA |
| 1003 | neutral | GGCGTTTACGGGCATGACGTAC | CCCGAAGCAATACTGTCGTCACTCTGTATGTCCGT |
| 1004 | neutral | GTCGAAAGGCGGCATGACGTAC | CCGGGAATCGGCATTTCGCATTCTTAGGATCTAAA |
| 1005 | neutral | GAGACAGGAGTGAATGAGTTTGAGTATGGAATGAC | CCGATCTTCATAACGGACAAACTGAACGGGCCATT |
| 1006 | binder | GTTAATGGAAGCTTGTCGCATGACGTACT | CGCTATGCAGACGAGCTGGCAGAGGAGAGAAATCA |
| 1007 | neutral | ATGATAAGGGTAGCTCGCATGACGTACT | CATTCGCAACCATGTGAAGTAATGTGAGCGTACTT |
| 1008 | neutral | GGCGCAATCGCATGACGTACT | CACCAGTTAGCGTGGCGTATACCATGTTGTTAACA |
| 1009 | neutral | GAGACAGTGATAATTTAGGGCTACGGAGTACG | CCTGAATCAATAGAACAATATCAGTTATGGCGGTG |
| 1010 | neutral | GAGACAGATGATTAGGGTAGTAGAGAACGCAC | CGGTTGTTAATATGACAGGCCGCTAAAGACGTTCT |
| 1011 | binder | GAGACAGTTTGAATCATGAGTTTGTGAAAGCGT | CCGTCTCAGATGAGTGGGTTAATCAATCAAGTATG |
| 1012 | binder | GAGAGAATAGGACGTACGCATGACGTACT | CTGACACATTAGTAACGTCGGCAAGCACTTAGTCG |
| 1013 | neutral | TGGGTGTGCGTACATGACGTACT | CGTGAACCAGATTATGTATGGACGCGCAATAGATA |
| 1014 | binder | GGTTTCCGCATTGCAGGACGTAC | CATACGAAATTTGAGCAAGCAATTGAAGGCTTAGA |
| 1015 | binder | CCCTGGCTCGCGACGTAC | CTATCAGCTAATAGGGTCGGCTCAACAGTGTATCC |
| 1016 | binder | CAGTAGAGAACAAGTCGCACGACGTAC | CTATCAATTCGTGACCCCGATCATCCAGTCCAGAA |
| 1017 | neutral | GAGACAGGCAAAGATGAAAGCGCATG | CTTGAGCTCTAGGCCCAAAACGACCTTAATGGTCA |
| 1018 | neutral | TGCCCGCCCTCACGTAC | CTAGCCCAGATCCTACGAGATGAGCTACGTAACTA |
| 1019 | neutral | GTTGGACCGCCCTCACGTAC | CAAATGCACTCTATATGGAGGGAGAGTAGCTGGAT |
| 1020 | neutral | ACTCCTGTACGCCCTCACGTAC | CCTGGTCTAGGTATCTAATTCGTGGGTCGGGTACT |
| 1021 | neutral | GCCATTAACTTCAGTAGCCCTCACGTAC | CATTAGCTCGGATGCTATCAGCTTGCGCCTATTAT |
| 1022 | neutral | GAGACAGGATAAAGGTAAGAAAAGCGGCTG | CACGATCTGTATTTTGCACCTTTCGCTATGCTGAG |

TABLE 30-continued

Complementary Probe Sequences

| SEQ ID NO | Type | Probe Complement Region 1504 | 3' Region (Probe Part A 1505) |
|---|---|---|---|
| 1023 | neutral | GAGACAGTCAGGAAGGAAAATGTACGCAC | CTGTGTCCGTCTATACGCATACTGGTCCACATATA |
| 1024 | neutral | GAGACAGAGGGACAAGGAGGAAATTGG | CATGTTGGAGTTAACGGAGACCCGCCATCGTTTAC |
| 1025 | neutral | GGACGGCCCCTCACGTAC | CGCTCATTTTGAACATACGATTGCGATTACGGAAA |
| 1026 | neutral | ATGACCGCCCCTCACGTACT | CCTATGCATCATGTGCCTCACTAGGACATCATGCT |
| 1027 | binder | CACAGTAGAGGAATATGCGCTATCACGTACT | CCTAAATTGGGAAAAAAGGTTTTAGCTATTGATGG |
| 1028 | binder | GAGACAGTCATTGGGCACGGTAGA | CTTCAGTTAAAGGCTATCTTGCTCCGCTCGTTCTC |
| 1029 | binder | GCACGGTAGAGAGTAGTTGCACGTAC | CTTAAAGCTATCCACGAATGTCAAAAATGTGGTTT |
| 1030 | binder | GAGACAGTATGAGATAAGCACAGTAGAGATTGACATGT | CCCGAATGTATAATGCTGACGTTCTTGCTTTTGGC |
| 1031 | binder | GAGACAGTAGGGGCACGGTAGAG | CCTATTGAAGCAATCCTCTCCCCAATACTTAAAAA |
| 1032 | neutral | GGGGGTGTCCTGCACGTAC | CTACGGTTACCGTCTTTATAAGTGAACAAAACCGG |
| 1033 | binder | GTAGAGTATCCACGCAAACTGCACGTAC | CTCTGTGAACTGTCATCGGTCCGATCAATTAGTCT |
| 1034 | binder | GCACGGTAGAGTTCATGTATGCACGTAC | CTCCCCTTTCCCAAGTAAATGTACGGGAATTATCG |
| 1035 | binder | GAGACAGGGCACGGTAGAGTAAAATAATGTGA | CGCTTTATTATGTGTTCGTCTAACTCTGTTTCTGT |
| 1036 | neutral | AAAGTGCGCCTGATGCACGTAC | CCGAGTGCATGAGCTGTCTTTCACATGATACATCG |
| 1037 | binder | CTCGAGAACGATACTGTGGCACGTAC | CTATTTCTGTTCACGGATGAAGGCCTATATCAATG |
| 1038 | neutral | CCCTCTCGCATGGCACGTAC | CCATCCACTTTCATGGAAACAATAAGAGCAGGGAA |
| 1039 | binder | GAGACAGTCACGTCATTTCAGATGGCA | CACAAACTCACTACTACCAACAACCTCACCAAAAA |
| 1040 | binder | GAGACAGTCAACCTTAATATAAGCACAGTAGAGTTACAAGTTC | CTCATGTCCTCTGTTAATCCAGCCTGAATATGCCA |
| 1041 | binder | GCACAGTAGAGTATTGGTCGCACGTAC | CAGAAATGTCACTCCCATGGTGGCTGATATAGAAA |
| 1042 | binder | GAGACAGAGGAGTGAGCACGGTT | CATGTCGAACCTTGGATAGGAGCGACCGATTACGT |
| 1043 | neutral | GGTTACATGGGCTTTATCGCACGTACT | CTCAGGTTGTTACTTGAAGGGTTCAACACGAGCTC |
| 1044 | binder | GGTAGAGACAACTTGCGCACGTACT | CAGAAGATCAAAAAACGATCCCTGTCCATCAATAC |
| 1045 | binder | GAGACAGAATAAAGCACGGTGGAGACAATG | CTTAGGCTACCAAATGAATTTAAAGCCAGCTGAAA |
| 1046 | binder | GAGACAGTAGGAAATAGGCACGGTAGAGTT | CCAATGCTTGCAGTATGTATCCTGATCGTGCGTGC |
| 1047 | binder | AGGTCGGTGCGCACGTAC | CCTGCATTCTCATGGAAATGCAATGGATTCATTCC |

TABLE 30-continued

Complementary Probe Sequences

| SEQ ID NO | Type | Probe Complement Region 1504 | 3' Region (Probe Part A 1505) |
|---|---|---|---|
| 1048 | binder | GTGTGGTGGCGCACGTACT | CCTGTTGCAGTATCACGTAAATAC CTACTTCGATA |
| 1049 | neutral | GAGACAGAAGAAAGTAATCGGAAGTCGG GTAG | CTAGCTGTTATGGCTATTGCTGAA ACAGCAAAATT |
| 1050 | binder | ACAGTAGAGTAATATAGTCCGCGCACGT AC | CCTTACGACTTCACTGCAATTGAC GATTCAGTTAA |
| 1051 | neutral | GAGACAGCAAAAAGGTGGTTGTATAAAG TGCC | CCTCATACCAATGTAAAGTATAGT TAACGCCCTGT |
| 1052 | binder | GAGACAGGATGGCACAGTGGAGTAAG | CATCTCCATGACTGCTTGAGCGGC TGGAGAATCTG |
| 1053 | binder | ACAGTAGAGGTCACCGCACGTAC | CTTTCGCCACCCATATAAACCCCA CTTCGTCCTCA |
| 1054 | binder | CGGTAGAGGTTCTGTACGCACGTAC | CAAGGCAGAGCAAATGTGACACTG TCTATCAGTAC |
| 1055 | binder | GGGAGGGGACGCACGTAC | CCTACATATATAGGAAAAGGGAAG GTAGAAGAGCT |
| 1056 | binder | GAGACAGGAAAATCGCATACGTCTTGCA TAC | CCTTCTGGAATTTCTTCCTTTGAT TTTGCCATTTT |
| 1057 | binder | GAGGTGGATCGGTCTAGCACGTAC | CTCCTAAGGTTGCTGATTTGGTTG TTGGAGACCCA |
| 1058 | binder | ACGGTAGAGCTAAGCTAGCACGTACT | CAAGGCCTAGCCTAAAGGTTCTTG CAGAGCAACAT |
| 1059 | neutral | CGGCCTGCAGCACGTACT | CCTAATTAGCTCTAGGAAACACAA CCCCGGGATTT |
| 1060 | neutral | GAACGCCTGACCAGCACGTAC | CTTGAGTTATACGGAACTTCGCAA AAGTATTCCCT |
| 1061 | binder | GAGACAGAAATGCACAGTAGAGTAAAAT ATCTTGCCTG | CCATCCATCAACAACTGCTCCAAC AGCCTTTCCAT |
| 1062 | binder | GAGACAGGCACAGTAGAGGTGAGGATA | CCGGCACAAGCAGACAAAATCAAC ATGGTCATTTA |
| 1063 | binder | GAGACAGGGCATAAAGGGCACAGTA | CGCTCACGTGATCTACCCTAGCTG ACCGCTAATGA |
| 1064 | binder | GAGACAGTCAAGGAGCACGGTAGAG | CTCTAACCTGCATACATATGGCAT TTAGTTGTTCA |
| 1065 | binder | GGCACGGTAGAGAAATCGCATAACGTAC | CCTTCTTGAAGACCTATGTAAAGA AACGGGTCACT |
| 1066 | neutral | GAGACAGAGGATAAGGTCGTGTAATAGG TGG | CCATACGCATGACTACATTACAAC GGGCCAGGAAG |
| 1067 | neutral | GAGACAGAGAAGAAAGTAAGCGTTGGCA C | CAGGTCTCGATCTCGTACAAAACG ACTATGACCAT |
| 1068 | neutral | CCGGCTATGACTGCTTGAACGTACT | CATGAACGTGTCGTGTTATGCAGC GGTATGTCGTG |
| 1069 | binder | GAGACAGTTTGGTGGCACGGTAGA | CGTCGTGTCTTAGACGACTGTGTG TGATTCTCGAG |
| 1070 | binder | GCGAAATGACTGCGCAACGTACT | CCACCGTTTTGCCAGTTCCACCAG TAACTGTAAGG |
| 1071 | binder | AGAGTACTACCGCCTGACAACGTACT | CGCCCTGGAACAACGGTTATATTC TCTGGCAGAAC |

Example 27: Oligonucleotide Probes: Aggressive Breast Cancer, Non-Aggressive Breast Cancer, and Non-Cancer This Example presents oligonucleotide probes identified in an oligonucleotide probe library enriched against plasma-derived microvesicles from patients with aggressive breast cancer, non-aggressive breast cancer, and non-cancer (breast biopsy-negative samples). The general methodology follows that in Example 26 above. Oligonucleotides were screened using plasma samples from 60 individuals with breast cancer and 60 individuals without breast cancer.

A combination of ultracentrifugation and PEG based partitioning of microvesicles from each input plasma sample. The F-TRin-35n-B 8-3s library as described herein was enriched against microvesicles from pooled plasma samples (cancer or non-cancer pools) which were isolated using ultracentrifugation. Subsequent enrichments were performed by isolating the microvesicles using PEG precipitation. As in Example 26, the input oligonucleotide library was exposed to positive, negative and again positive targets sequentially and then PCR amplified. We performed two parallel tracks of initial enrichment against pooled samples, one track where pooled cancer samples were considered positive and non-cancer samples were negative, and another track where pooled non-cancer samples were considered positive and cancer samples were negative. The enriched libraries resulting from each track were pooled together before probing individual patient samples in the following experiments.

Oligonucleotides that Distinguish Aggressive and Non-Aggressive Breast Cancer

We first identified oligonucleotides that distinguished between aggressive and non-aggressive breast cancer. For these experiments, the aggressive breast cancer patient samples were considered as positive samples (31 samples) and non-aggressive breast cancer patient samples were considered as negative samples (29 samples). The enriched libraries from above were subjected to the oligonucleotide probing assay on the individual cancer plasma samples. A two-step normalization procedure was performed to normalize the sum of the copy numbers for all oligonucleotides associated with the PEG-precipitated pellet. The copy number of each recovered oligonucleotide was divided by the total number of sequence reads for each sample, then multiplied by the mean of totals of all samples. This data treatment accounts for the different number of sequence reads for each patient even though the same amount of DNA library was added for each patient-sample. The final value for each oligonucleotide for each patient is the average of normalized copy numbers from three probing replicates. We excluded oligonucleotides with an average read-count across all patients ≤100, and subsequently selected among the remaining oligonucleotides only those that show a >20% CV across the 60 patient samples. This process resulted in approximately 12000 remaining oligonucleotides.

We compared patient profiles using clustering analysis with one minus Pearson correlation coefficients $(1-P_c)$ as the distance measure. The resulting heat-map based on the number of oligonucleotide sequence counts allows for visualisation of similarities in oligonucleotide copy numbers among all patient samples. See FIG. 15. In the figure, the X-axis shows individual oligonucleotides and the Y-axis shows samples (aggressive or other (i.e., non-aggressive)). Oligonucleotides from the indicated Cluster 1 have relatively low counts for the majority of aggressive cancers. Oligonucleotides from the indicated Clusters 2 and 3 have relatively higher counts in a majority of aggressive cancer samples. It is noted that oligonucleotide probes that are observed at either higher or lower relative copy number in the advanced cancer samples versus non aggressive can be used as markers to distinguish these sample groupings. Oligonucleotides from the indicated Cluster 4 were more selective toward particular aggressive cancer samples, and were able to identify additional 12 advanced cancer samples that were missed by oligonucleotides in Clusters 1-3. Cluster 4 oligonucleotides may be useful for detecting particular subsets of aggressive cancers.

Figure 15:
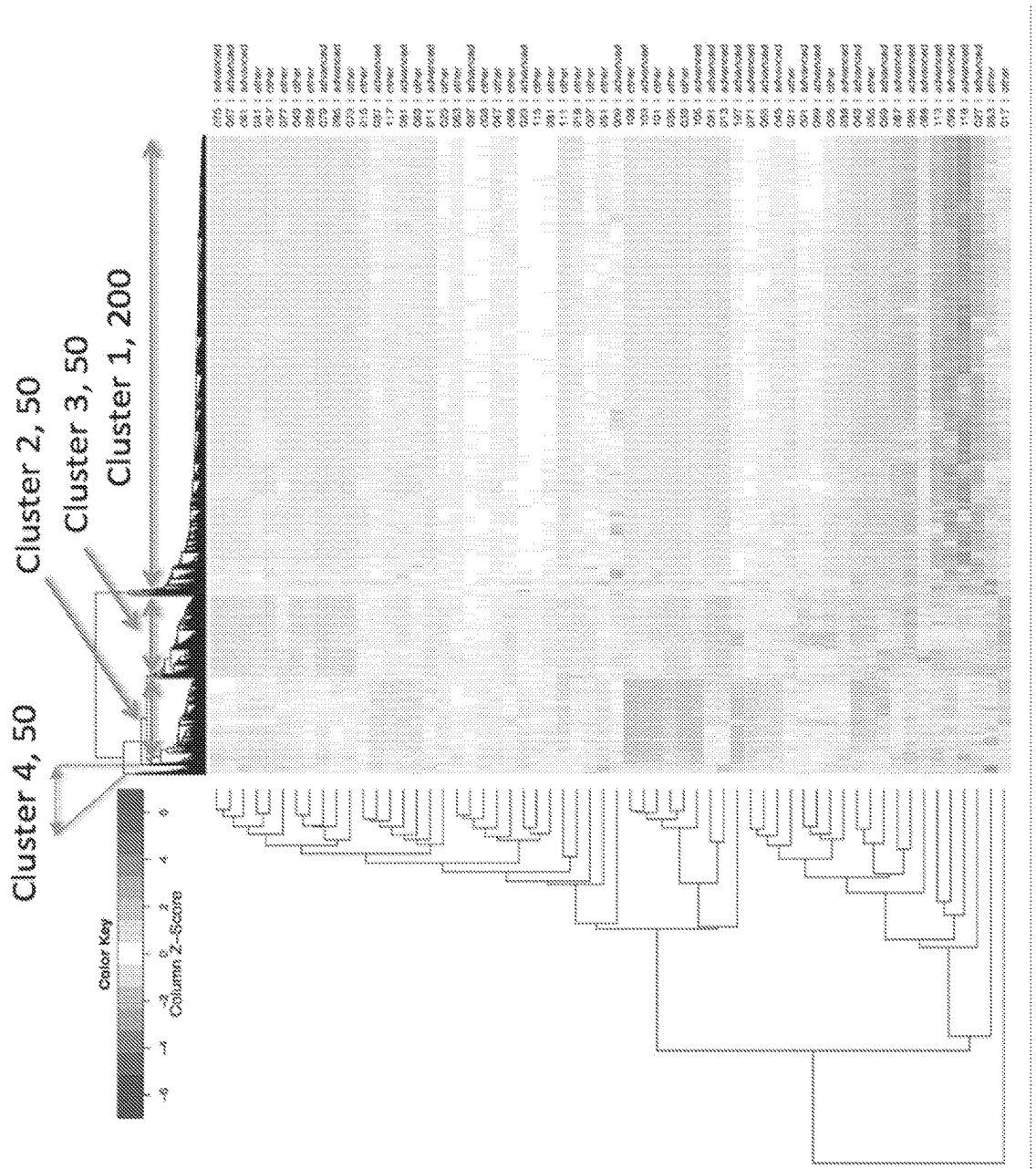
FIG. 15 shows a heatmap of clusters of oligonucleotides enriched against aggressive versus non-aggressive breast cancer plams samples.

The distances between samples within each cluster are considerably smaller than the distance between the two clusters. As can be seen in FIG. 15, these two groups of samples have very different proportions of advanced cancer cases versus other; in cluster I, 15 of the 19 patients are advanced cancer cases (79%), while in cluster II, only 16 of 40 patients are advanced cases (40%). Fisher exact p-value equals 0.01 with an odds ratio of 4.9, indicating that the ratio of advanced to other cancer in these two clusters is statistically significant.

The SEQ ID NOs. of the variable regions from the oligonucleotides in Clusters 1-4 in FIG. 15 are shown in Table 31. As in Table 27, the oligonucleotides were each synthesized with a 5' region consisting of the sequence (5'-CTAGCATGACTGCAGTACGT (SEQ ID NO. 131)) and a 3' region consisting of the sequence (5'-CTGTCTCT-TATACACATCTGACGCTGCCGACGA (SEQ ID NO. 132)) flanking the variable region. The sequences can be used in the identification of aggressive breast cancer samples.

TABLE 31

Clusters 1-4 Variable Regions SEQ ID NOs

| Cluster | SEQ ID NO |
|---|---|
| Cluster 4 | 1072-1121 |
| Cluster 3 | 1122-1171 |
| Cluster 2 | 1172-1221 |
| Cluster 1 | 1222-1421 |

A selection of 50 negative control oligonucleotides was made from the same experiments as above. As criteria, we chose those oligonucleotides with the lowest variability (% cv) between biological samples when taking all 120 samples from the noted probing into account. The variable regions of the 50 negative controls are listed in SEQ ID NOs 1422-1471. As in Table 27, the oligonucleotides were synthesized with a 5' region consisting of the sequence (5'-CTAGCAT-GACTGCAGTACGT (SEQ ID NO. 131)) and a 3' region consisting of the sequence (5'-CTGTCTCTTATACA-CATCTGACGCTGCCGACGA (SEQ ID NO. 132)) flanking the variable regions. These sequences can be used as negative controls when identifying aggressive breast cancer samples.

Oligonucleotides Specific to Non-Cancer Samples Versus Cancer Samples

We also identified a set of oligonucleotides that were specific to the non-cancer plasma samples. In addition to probing the cancer samples noted above, the enriched oligonucleotide probe library was used to perform the probing test on the 60 individual non-cancer plasma samples. Each sample was probed as described above. The oligonucleotides recovered with each individual non-cancer and cancer plasma sample were identified using next-generation sequencing. The averaged frequencies of individual oligonucleotide sequence reads between non-cancer and cancer samples were used to calculate a fold-change of non-cancer versus cancer. Oligonucleotides with both read counts above 100 and fold change (non-cancer/cancer) greater or equal to 2 were identified as non-cancer specific oligonucleotide probes (SEQ ID NOs. 1472-1486). In addition, a selection of negative control oligonucleotides were selected as those with fold change less than or equal to 1 and read count below 20 (SEQ ID NOs 1487-1501).

The variable regions of the non-cancer specific oligonucleotides and negative control oligonucleotides are listed by rank order in SEQ ID NOs. 1472-1486 and SEQ ID NOs 1487-1501, respectively. As in Table 27, the oligonucleotides were synthesized with a 5' region consisting of the sequence (5'-CTAGCATGACTGCAGTACGT (SEQ ID NO. 131)) and a 3' region consisting of the sequence (5'-CTGTCTCTTATACACATCTGACGCTGCCGACGA (SEQ ID NO. 132)) flanking the variable regions. The sequences can be used to identify non-cancer samples (SEQ ID NOs. 1472-1486) or used as negative controls for such experiments (SEQ ID NOs 1487-1501).

Oligonucleotides Specific to Cancer Samples Versus Non-Cancer

We then identified a set of oligonucleotides that were specific to the cancer plasma samples as compared to the non-cancer samples. Pooled cancer and non-cancer samples were probed as described above. The oligonucleotides recovered with each individual cancer and non-cancer plasma sample were identified using next-generation sequencing. The averaged frequencies of individual oligonucleotide sequence reads between cancer and non-cancer samples were used to calculate a fold-change of cancer versus non-cancer. Oligonucleotides with both read counts above 10 and fold change (non-cancer/cancer) greater or equal to 1.5 were identified as cancer specific oligonucleotide probes (SEQ ID NOs. 1502-1539). In addition, a selection of negative control oligonucleotides were selected as those with fold change less than or equal to 1 and read count below 20. See SEQ ID NOs 1487-1501 as described above.

The variable regions of the cancer specific oligonucleotides are listed by rank order in SEQ ID NOs. 1502-1539. As in Table 27, the full length oligonucleotides were synthesized with a 5' region consisting of the sequence (5'-CTAGCATGACTGCAGTACGT (SEQ ID NO. 131)) and a 3' region consisting of the sequence (5'-CTGTCTCTTATA-CACATCTGACGCTGCCGACGA (SEQ ID NO. 132)) flanking the variable regions. These sequences which can be used to identify cancer samples.

Example 28: Oligonucleotide Probes: Aggressive Breast Cancer, Non-Aggressive Cancer and Non-Cancer/Healthy Blood Plasma Targets with UC and PEG This Example builds on the work presented in Example 27. Based on the results of the probing Aggressive cancer pool (50% patients with aggressive breast cancer), Non-Aggressive cancer pool and Healthy Pool (50% biopsy confirmed non-cancer and 50% healthy non-cancer), we obtained aptamers specific for:

Aggressive cancer compared to non-aggressive cancer and to non-cancer/healthy samples.

Non-aggressive cancer compared to aggressive and to non-cancer/healthy samples.

Non-Cancer/Healthy samples compared to aggressive and non-aggressive samples.

A combination of ultracentrifugation and PEG based partitioning of microvesicles from each input plasma sample. This approach potentially provides a cleaner patient sample and thus provide higher specificity for the intended target. As in Example 27, the input oligonucleotide library was exposed to positive, negative and again positive targets sequentially and then PCR amplified. Enriched libraries were subjected to the oligonucleotide probing assay on the plasma samples using sample pools as follows: ACP—aggressive cancer pool; NACP—non-aggressive cancer pool; HP—healthy pool (mix of non-cancer and normal samples). Each sample pool was probed two naïve (i.e., untrained) oligonucleotide probe libraries (6-3S and 8-3S described herein) with three replicates. Samples were sequenced in multiplex with 9 samples per flow cell. Indexing PCR was performed either with or without internal standard. The average number of sequence read counts between three replicates was considered for fold change and TTEST calculations. Sequences were identified that met the following criteria: fold change between pools>=2; p-value=<0.05, % cv=<20%, counts>=100.

The joint selection of oligonucleotides that passed the above criteria is shown in Tables 32 and 33. As in Table 27, the oligonucleotides each have a 5' region consisting of the sequence (5'-CTAGCATGACTGCAGTACGT (SEQ ID NO. 131)) and a 3' region consisting of the sequence (5'-CTGTCTCTTATACACATCTGACGCTGCCGACGA (SEQ ID NO. 132)). Tables 32 and 33 list in rank order the SEQ ID NOs of the variable region that are positioned between the 5' and 3' regions. The differences are that the starting libraries were derived from a first round of enrichment against a cancer pool (Table 32) or a first round of enrichment against a non-cancer pool (Table 33). However, after the first round the aliquots were pooled for subsequent enrichment. The combined oligonucleotide probe library can be used to distinguish between aggressive breast cancer, non-aggressive breast cancer, and non-cancer plasma samples in a single assay according to the column "Comparison." In the Comparison column, sequences elevated in group 1 as compared to group 2 are shown as group 1/group 2. The legend for this column is "ACP": Aggressive cancer pool; "HP": healthy & non-cancer pool; "NACP": Non-aggressive cancer pool. "IntSt" in the comparison row indicates that an internal standard was used during the enrichment. By way of illustration, the first two sets of comparisons in Table 32 are labeled ACP/HP, which indicates that these oligonucleotides were observed at high copy numbers after probing the aggressive breast cancer sample pool versus the healthy/non-cancer sample pool. Continuing with this illustration, higher numbers of such oligonucleotide probes binding to a sample can indicate the presence of an aggressive breast cancer.

TABLE 32

Oligonucleotide Probe Comparison and Variable Regions

| Comparison | SEQ ID NO. |
| --- | --- |
| ACP/HP (IntSt) | 1540-1551 |
| ACP/HP | 1552-1585 |
| HP/ACP (IntSt) | 1586-1611 |
| HP/ACP | 1612-1650 |
| NACP/HP (IntSt) | 1651-1655 |
| NACP/HP | 1656-1733 |
| HP/NACP (IntSt) | 1734-1754 |
| HP/NACP | 1755-1789 |
| NACP/ACP (IntSt) | 1790-1793 |
| ACP/NACP (IntSt) | 1794-1805 |
| ACP/NACP | 1806-1815 |

TABLE 33

Oligonucleotide Probe Comparison and Variable Regions

| Comparison | SEQ ID NO. |
|---|---|
| ACP/HP (IntSt) | 1816-1822 |
| ACP/HP | 1823-2004 |
| HP/ACP (IntSt) | 2005-2054 |
| HP/ACP | 2055-2234 |
| NACP/HP (IntSt) | 2235-2242 |
| NACP/HP | 2243-2318 |
| HP/NACP (IntSt) | 2319-2356 |
| HP/NACP | 2357-2491 |
| NACP/ACP (IntSt) | 2492-2507 |
| NACP/ACP | 2508-2583 |
| ACP/NACP (IntSt) | 2584-2593 |
| ACP/NACP | 2594-2728 |

Example 29: Oligonucleotide Probes: Non-Aggressive Cancer Probes Identified in Libraries Enriched with Multiple Protocols This Example builds on the work presented in Example 28. Here, we identified a set of oligonucleotide probes specific for non-aggressive cancer samples. The oligonucleotide probes were identified based on probing using an aggressive cancer pool (ACP), non-aggressive cancer pool (NACP) and healthy pool (HP) of plasma samples with naïve oligonucleotide libraries. Compared to the work in Example 28, four different enrichment schemes were used, as further detailed below. For purposes of these experiments, non-aggressive (or non-advanced) cancer is defined as sample with tumor size not exceeding stage T1, presence of nodes N0, Metastasis M0 and positive estrogen/progesterone receptors.

In each case, the enriched libraries were subjected to the probing test on pooled plasma samples. The library enrichment was performed as described herein, see e.g., Example 21. The libraries were exposed to positive and negative targets and PCR amplified either after each binding or after series positive-negative-positive binding as described below. The positive and negative pools are indicated below for the different enrichment schemes. After each round of enrichment, next generation sequencing was used to determine a copy number of the recovered oligonucleotide probes. Averaged frequencies of individual oligonucleotide between the indicate pools were used to calculate the fold change. Oligonucleotide with counts above 50, fold change>=2 and % cv between replicates below 20% were considered as candidates and shown in the tables below.

Scheme 1

The positive target was the NACP plasma and the negative target was the HP plasma. The enrichment started with the naïve (non-enriched; NE) library. Microvesicles in the samples were isolated using ultracentrifugation in all stages. Each round of enrichment consisted of a complete set of positive-negative-positive binding events followed by PCR amplification of the enriched library. Two such rounds of binding were performed. The resulting library after the second enrichment (R2) is used for subsequent probing of the pooled samples (aggressive cancer, non-aggressive cancer and healthy). As in Example 28 above, comparisons performed included ACP/HP, HP/ACP, ACP/NACP, NACP/ACP, HP/NACP, NACP/HP.

Resulting oligonucleotides identified in these selections are shown in Table 34. As in Table 27, the oligonucleotides each have a 5' region consisting of the sequence (5'-CTAGCATGACTGCAGTACGT (SEQ ID NO. 131)) and a 3' region consisting of the sequence (5'-CTGTCTCTTATACACATCTGACGCTGCCGACGA (SEQ ID NO. 132)). Table 34 lists the SEQ ID NOs in rank order of the variable regions that are positioned between the 5' and 3' regions. The combined oligonucleotide probe library can be used to distinguish between aggressive breast cancer, non-aggressive breast cancer, and non-cancer plasma samples in a single assay according to the column "Comparison." In the Comparison column, sequences elevated in group 1 as compared to group 2 are shown as group 1/group 2. The legend for this column is "ACP": Aggressive cancer pool; "HP": healthy & non-cancer pool; "NACP": Non-aggressive cancer pool. By way of illustration, the first two sets of comparisons in Table 34 are labeled ACP/HP, which indicates that these oligonucleotides were observed at high copy numbers after probing the aggressive breast cancer sample pool versus the healthy/non-cancer sample pool. Continuing with this illustration, higher numbers of such oligonucleotide probes binding to a sample can indicate the presence of an aggressive breast cancer.

TABLE 34

Enrichment Scheme 1 Oligonucleotide Probe Comparison and Variable Regions

| Comparison | SEQ ID NO. |
|---|---|
| HP/ACP | 2729-2737 |
| ACP/HP | 2738-2742 |
| ACP/NACP | 2743-2745 |
| NACP/ACP | 2746-2753 |
| NACP/HP | 2754 |
| HP/NACP | 2755-2763 |

Scheme 2

In this enrichment, the positive target is NACP plasma and the negative target is the HP plasma. The starting input library is the C-R8N-1 (i.e., previously enriched for a cancer pool with 48% of aggressive cancer samples; see description of the C-RN7 library in Example 26 with one additional round of positive selection performed). The microvesicle partitioning was performed using PEG precipitation. PCR amplification is done after each binding. The resulting library after this ninth (Round 9) round of enrichment is used for probing. Three different input criteria for used for round 9: 1) R9-2—library input 0.1 ng; 2) R9-1c—library input is 1 ng; 3) R9-5× input of competitor DNA. The R9-2 and R9-1c oligonucleotide libraries were then used for subsequent probing of the pooled samples (aggressive cancer, non-aggressive cancer and healthy). As above, comparisons performed included ACP/HP, HP/ACP, ACP/NACP, NACP/ACP, HP/NACP, NACP/HP.

Resulting oligonucleotides identified from the R9-1c and R9-2 oligonucleotide libraries in these selections are shown in Table 35 and Table 36, respectively. As in Table 27, the oligonucleotides each have a 5' region consisting of the sequence (5'-CTAGCATGACTGCAGTACGT (SEQ ID NO. 131)) and a 3' region consisting of the sequence (5'-CTGTCTCTTATACACATCTGACGCTGCCGACGA (SEQ ID NO. 132)). Tables 35 and 36 list the SEQ ID NOs in rank order of the variable regions that are positioned between the 5' and 3' regions. When combined, the oligonucleotide probe libraries can be used to distinguish between aggressive breast cancer, non-aggressive breast cancer, and non-cancer plasma samples in a single assay according to the column "Comparison." In the Comparison column, sequences elevated in group 1 as compared to group 2 are shown as group 1/group 2. The legend for this column is "ACP": Aggressive cancer pool; "HP": healthy & non-cancer pool; "NACP": Non-aggressive cancer pool. By way of illustration, the first two sets of comparisons in Table 35 are labeled ACP/HP, which indicates that these oligonucleotides were observed at high copy numbers after probing the aggressive breast cancer sample pool versus the healthy/non-cancer sample pool. Continuing with this illustration, higher numbers of such oligonucleotide probes binding to a sample can indicate the presence of an aggressive breast cancer.

TABLE 35

Enrichment Scheme 2 R9-1c Oligonucleotide Probe Comparison and Variable Regions

| Comparison | SEQ ID NO. |
| --- | --- |
| ACP/HP | 2764-2791 |
| HP/ACP | 2792-2793 |
| ACP/NACP | 2794-2815 |
| NACP/ACP | 2816-2830 |
| HP vs NACP | 2831-2845 |
| NACP vs HP | 2846-2858 |

TABLE 36

Enrichment Scheme 2 R9-2 Oligonucleotide Probe Comparison and Variable Regions

| Comparison | SEQ ID NO. |
| --- | --- |
| ACP/HP | 2859-2867 |
| HP/ACP | 2868-2892 |
| ACP/NACP | 2893-2904 |
| NACP/ACP | 2905-2938 |
| HP/NACP | 2939-2941 |
| NACP/HP | 2942-2950 |

Scheme 3

The positive target was the NACP plasma and the negative target was the HP plasma. The enrichment started with the naïve (non-enriched; NE) library. Microvesicles in the samples were isolated using PEG precipitation. Six rounds of enrichment were performed with PCR amplification performed after each round. The round alternated between a single selection of positive or negative selection (i.e., positive selection in rounds 1, 3, 5 and negative selection in rounds 2, 4, and 6). The resulting library after round 6 is used for probing of the pooled samples (aggressive cancer, non-aggressive cancer and healthy) with library input 0.1 ng. As above, comparisons performed included ACP/HP, HP/ACP, ACP/NACP, NACP/ACP, HP/NACP, NACP/HP.

Resulting oligonucleotides identified in these selections are shown in Table 37. As in Table 27, the oligonucleotides each have a 5' region consisting of the sequence (5'-CTAGCATGACTGCAGTACGT (SEQ ID NO. 131)) and a 3' region consisting of the sequence (5'-CTGTCTCTTATACACATCTGACGCTGCCGACGA (SEQ ID NO. 132)). Table 37 lists the SEQ ID NOs in rank order of the variable regions that are positioned between the 5' and 3' regions. The combined oligonucleotide probe library can be used to distinguish between aggressive breast cancer, non-aggressive breast cancer, and non-cancer plasma samples in a single assay according to the column "Comparison." In the Comparison column, sequences elevated in group 1 as compared to group 2 are shown as group 1/group 2. The legend for this column is "ACP": Aggressive cancer pool; "HP": healthy & non-cancer pool; "NACP": Non-aggressive cancer pool. By way of illustration, the first two sets of comparisons in Table 37 are labeled ACP/HP, which indicates that these oligonucleotides were observed at high copy numbers after probing the aggressive breast cancer sample pool versus the healthy/non-cancer sample pool. Continuing with this illustration, higher numbers of such oligonucleotide probes binding to a sample can indicate the presence of an aggressive breast cancer.

TABLE 37

Enrichment Scheme 3 Oligonucleotide Probe Comparison and Variable Regions

| Comparison | SEQ ID NO. |
| --- | --- |
| ACP/HP | 2951-2960 |
| HP/ACP | 2961-2972 |
| ACP/NACP | 2973-2976 |
| NACP/ACP | 2977-2990 |
| HP vs NACP | 2991-3003 |
| NACP/HP | 3004-3017 |

Scheme 4

Starting aptamer library is C-R8N-3 (library previously enriched for Cancer pool with 48% of aggressive cancer samples and input 0.001 ng). Microvesicles in the samples were isolated using PEG precipitation. PCR amplification is done after each binding. There was only negative target used (the NACP), which is unique for the selection scheme versus the three above. This enrichment was meant to further enrich C-R8N library toward aggressive cancer targets by removing oligonucleotides specific to non-aggressive targets. Four negative selection rounds were performed. Two different input criteria for used for probing after round 13 (R13): 1) R13-3—library input 0.01 ng; 2) R13-4—library input 0.001 ng. The R13-3 and R13-4 oligonucleotide libraries were then used for subsequent probing of the pooled samples (aggressive cancer, non-aggressive cancer and healthy). As above, comparisons performed included ACP/HP, HP/ACP, ACP/NACP, NACP/ACP, HP/NACP, NACP/HP.

The variable regions of the resulting oligonucleotides identified from the R13-3 and R13-4 oligonucleotide libraries in these selections are shown in Table 38 and Table 39, respectively. As in Table 27, the oligonucleotides each have a 5' region consisting of the sequence (5'-CTAGCATGACTGCAGTACGT (SEQ ID NO. 131)) and a 3' region consisting of the sequence (5'-CTGTCTCTTATACACATCTGACGCTGCCGACGA (SEQ ID NO. 132)). Tables 38 and 39 list the SEQ ID NOs in rank order of the variable regions that are positioned between the 5' and 3' regions. When combined, the oligonucleotide probe libraries can be used to distinguish between aggressive breast cancer, non-aggressive breast cancer, and non-cancer plasma samples in a single assay according to the column "Comparison." In the Comparison column, sequences elevated in group 1 as compared to group 2 are shown as group 1/group 2. The legend for this column is "ACP": Aggressive cancer pool; "HP": healthy & non-cancer pool; "NACP": Non-aggressive cancer pool. By way of illustration, the first two sets of comparisons in Table 38 are labeled ACP/HP, which indicates that these oligonucleotides were observed at high copy numbers after probing the aggressive breast cancer sample pool versus the healthy/non-cancer sample pool. Continuing with this illustration, higher numbers of such oligonucleotide probes binding to a sample can indicate the presence of an aggressive breast cancer.

TABLE 38

Enrichment Scheme 4 R13-3 Oligonucleotide Probe Comparison and Variable Regions

| Comparison | SEQ ID NO. | Variable Region Sequence |
|---|---|---|
| ACP/HP | 3018-3030 | ACCATCGGGTCACGTAAAAGCGGTTCTAATTTCTAA |
| HP/ACP | 3031-3043 | ACGCAGTGCCGCCGAATCCTGATCCCCTAACTTTC |
| ACP/NACP | 3044-3052 | ACCACTGAACTCATGGTACTAATCACACACCAATT |
| NACP/ACP | 3053-3061 | ACTGACTGCATACATCCGCATATTAAACCCGTATT |
| HP/ACP | 3062-3083 | ACGCCTGTACGATGTCCTCGGTCTCATTTTATTTC |
| ACP/HP | 3084-3096 | ACTGCGGTCATCGAGTTACTGGCTATTGCCTGACC |

TABLE 39

Enrichment Scheme 4 R13-4 Oligonucleotide Probe Comparison and Variable Regions

| Comparison | SEQ ID NO. | Variable Region Sequence |
|---|---|---|
| ACP/HP | 3097-3099 | AATGCATTGCGTTATTTCAATTGAGGCGTCCTAAAA |
| HP/ACP | 3100-3107 | CATACGCACGGTCCTCTACTATAATTGTCCACCAA |
| ACP/NACP | 3108-3117 | AGCCCGTTGCTACGTTGCAGTAGGTGTAACTTCACTGA |
| NACP/ACP | 3118-3130 | AGCGGTCACCGCCTATGGTTATTCATTTTTCTCTTA |
| HP/NACP | 3131-3141 | AGCCCGTTGCTACGTTGCAGTAGGTGTAACTTCACTGA |
| NACP/HP | 3142-3150 | ACCACGTTGGTTATTGCCCTGCTTTGAAGTCTTACGA |

Example 30: Use of an Oligonucleotide Probe Library to Characterize Breast Cancer Samples An oligonucleotide probe library comprising approximately 2000 different probe sequences was constructed and used to probe approximately 500 individual breast cancer and non-cancer samples. The probe sequences were derived from different screening experiments and are listed herein in SEQ ID NOs 137-969 and 1072-3150. The oligonucleotides listed in these tables were synthesized and pooled together. The samples were plasma samples from 212 breast cancer patients, 177 biopsy confirmed non-cancer patients, and 117 normal control patients (self-reported as non-cancer). Experiments details are as provided above. The plasma samples were contacted with the oligonucleotide probe library and microvesicles were isolated using PEG precipitation. Oligonucleotides that were recovered with the microvesicles were isolated. Next Generation Sequencing (Illumina HiSeq) was used to identify the isolated sequences for each sample.

Analysis of significance of difference identified 18 aptamers with p-values below 0.01 when compared Cancer/Normal, 15 aptamers with p-values below 0.001 when compared cancer/Non-Cancer, 28 aptamers with p-values below 0.001 when compared Non-Cancer/Normal.

Multi-oligonucleotide panels were next constructed using a cross-validation approach. Briefly, 50 samples were randomly withheld from the sample cohort. The performance of individual oligonucleotides to distinguish the remaining cancers and non-cancer/normals was determined using logistic regression methodology. Additional oligonucleotides were added iteratively and performance was assessed using logistic regression until further performance improvements were no longer obtained with additional oligonucleotides. The approach generally led to panels of approximately 20-100 different probe sequences. The constructed panels were then used to classify the 50 withheld samples and diagnostic performance was assessed using Receiver Operating Curve (ROC) analysis and estimation of the Area Under the Curve (AUC).

In approximately 300 rounds of cross-validation, the average AUC was 0.6, thus showing that the average performance was statistically better than random (i.e., AUC of 0.5) and that the probe library could distinguish breast cancer and non-breast cancer/normal patient samples. AUC values as high as 0.8 were observed for particular cross validations. FIGS. 16A-B illustrate a model generated using a training (FIG. 16A) and test (FIG. 16B) set from a round of cross validation. The AUC was 0.803. The variable regions of the sequences used to build this model are shown in Table 40. Another exemplary round of cross-validation is shown in FIGS. 16C-D. The AUC was 0.678.

The SEQ ID NOs. of the sequences used in the model in FIGS. 16A-B are listed in rank in Table 40. As in Table 27, the oligonucleotides were synthesized with a 5' region consisting of the sequence (5'-CTAGCATGACTGCAG-TACGT (SEQ ID NO. 131)) and a 3' region consisting of the sequence (5'-CTGTCTCTTATACACATCTGACGCTGC-CGACGA (SEQ ID NO. 132)) flanking the variable regions.

TABLE 40

Oligonucleotide Probe Variable Regions
Rank Ordered SEQ ID NOs 215, 1286, 961, 1837, 780, 1319, 3032, 626, 2816, 1311, 364, 3102, 3115, 886, 414, 517, 599, 246, 416, 223, 507, 586, 1455, 1560, 1241, 2771, 1513, 2994, 2757, 461, 1917, 1178, 299, 1409, 959, 785, 322, 636, 1244, 665, 592, 823, 168, 1183, 3000, 182, 534, 1580, 2753, 2989, 1957, 2829, 1960, 856, 3149, 283, 1551, 1974, 605, 363, 266, 3140, 2242, 1306, 652, 634, 2763, 1270, 1728, 893, 1266, 1372, 1141, 1731, 1197, 1649

The data presented in this Example demonstrate that an oligonucleotide pool comprising members having the variable regions listed in SEQ ID NOs 137-969 and 1072-3150, e.g., a pool of probes having the variable regions listed in Table 40, can be used to distinguish plasma from individuals having breast cancer versus plasma from non-breast cancer individuals.

Example 31: Updated Oligonucleotide Pools to Characterize Breast Cancer Samples The profiling of 500 clinical samples with an oligonucleotide probe library comprising 2000 oligonucleotides showed significant ability to distinguish breast cancer from non-cancer control samples. See Example 30 above. When performing cross-validation in these experiments, it was observed that 85 out of 500 were misclassified at a higher rate compared to the other samples. We therefore identified another selection of oligonucleotide probe which were able to correctly classify the noted samples. These 85 samples were profiled with a naïve oligonucleotide probe library (6-3S/8-3S), and enriched on breast cancer and non-cancer plasma using methodology presented in the Examples above. The selected oligonucleotides were compared to a positive controls cohort, which comprised of the cancer and non-cancer samples that were consistently classified correctly within the experiments in Example 30 above. Oligonucleotides were selected based on absolute number of copies sequenced of at least 50 and various criteria when comparing sample groups including: 1) copy number fold-change (fc) of at least 1.2; 2) effect size (es) above 0.6; 3) t-test (p-value<=0.05); and 4) Kolmogorov-Smirnov test (ks) (p-value<=0.05). Effect size is a population effect size calculated as (mean(group1)−mean(group2))/standard deviation(group1 and group2).

The profiling data were normalized by dividing the count of each particular oligonucleotide by the total counts for particular sample and multiplying by the global mean across the entire experiment. These normalized values were used to calculate the statistical criteria specified above to compare the following samples type: Misclassified Cancer ("C"), misclassified non-cancer ("NC"), positive control Cancer ("C-P"), positive control Non-Cancer ("NC-P"), misclassified Normal ("N"). The comparisons performed and numbers of resulting oligonucleotides are shown in Table 41. Negative controls are oligonucleotides that did not match any criteria and thus should not distinguish be any samples groups.

TABLE 41

Oligonucleotide probe candidates were selected from the following comparisons

| Specificity | Total |
| --- | --- |
| C/NC-P* A** and C/NC-P B*** | 82 |
| C/NC-P A | 108 |
| C/NC-P B | 13 |

TABLE 41-continued

Oligonucleotide probe candidates were selected from the following comparisons

| Specificity | Total |
| --- | --- |
| Negative control | 60 |
| C-P/NC A C-P/NC B | 34 |
| C-P/NC A | 68 |
| C-P/NC B | 101 |
| NC/C-P A NC/C-P B | 7 |
| NC/C-P A | 196 |
| NC-P/C A NC-P/C B | 65 |
| NC-P/C A | 83 |
| NC-P/C B | 55 |
| C + C-P/N | 103 |
| N/C + C-P | 25 |
| Total | 1000 |

*"C/NC-P" in Table 41 means that oligonucleotides were selected with specificity toward cancer ("C") while compared to Non-Cancer positive ("NC-P") control.
A** - selection criteria: counts > 50, fc ≥ 1.2, es > 0.6, ttest p < 0.05,
B*** - selection criteria: counts > 200, estimated sample size < 71, fc > 1.2, ttest/ks test p < 0.05.

The sequences selected based on Table 41 are shown in Table 42. As in Table 27, the oligonucleotides each have a 5' region consisting of the sequence (5'-CTAGCATGACTGCAGTACGT (SEQ ID NO. 131)) and a 3' region consisting of the sequence (5'-CTGTCTCTTATACACATCTGACGCTGCCGACGA (SEQ ID NO. 132)). Table 42 lists in rank order the SEQ ID NOs of the variable regions that are positioned between the 5' and 3' regions. The column "Specificity" shows the specificity of the oligonucleotides based on the comparisons in Table 41.

TABLE 42

Oligonucleotide Probe Variable Regions

| Specificity | SEQ ID NO. |
| --- | --- |
| C/NC-P A and C/NC-P B | 3151-3232 |
| C/NC-P A | 3233-3340 |
| C/NC-P B | 3341-3353 |
| Negative control | 3354-3368 |
| C-P/NC A C-P/NC B | 3369-3402 |
| C-P/NC A | 3403-3470 |
| C-P/NC B | 3471-3571 |
| Negative control | 3572-3586 |
| NC/C-P A NC/C-P B | 3587-3593 |
| NC/C-P A | 3594-3789 |
| Negative control | 3790-3804 |
| NC-P/C A NC-P/C B | 3805-3869 |
| NC-P/C A | 3870-3952 |
| NC-P/C B | 3953-4007 |
| Negative control | 4008-4022 |
| C/N | 4023-4125 |
| N/C | 4126-4150 |

The 1000 selected oligonucleotides are synthesized as DNA with a 5' biotinylation. The synthesized oligonucleotides are pooled with 1000 of the most informative aptamers from the profiling performed in Example 30 to create a further optimized oligonucleotide probing library that can be used to distinguish cancer and normal samples.

Example 32: Comparison of Oligonucleotide Pools

In this Example, the performance of the oligonucleotide pool from Example 30 was compared to the performance of the oligonucleotide pool from Example 31 to characterize breast cancer samples. In this Example, the oligonucleotide pool from Example 30 is referred to as the 2000v1 and the oligonucleotide pool from Example 30 is referred to as the 2000v2. A random forest approach was used to analyze the data, which data was obtained for the 2000v1 library in Example 30. The 2000v2 data was obtained via tested on a cohort of 858 plasma samples which comprised some samples described in Example 30 with additional samples according to three groupings: 194 breast cancer positive, 382 breast cancer negative as confirmed by biopsy ("non-cancer"), and 282 self declared normals ("normal").

ROC curves are shown in FIGS. 22A-D for the various settings. AUC values are shown above the curve and are statistically significant from random (i.e., AUC=0.5) in all cases. In FIG. 22A, the 2000v1 probe library was used to distinguish cancer samples versus biopsy confirmed non-cancer samples. In FIG. 22B, the 2000v2 probe library was used to distinguish the same sample groupings. A small improvement in AUC was observed with the 2000v2 probe library in this setting. In FIG. 22C, the 2000v1 probe library was used to distinguish cancer samples versus self-declared normal samples. In FIG. 22D, the 2000v2 probe library was used to distinguish the same sample groupings. A small decline in AUC was observed with the 2000v2 probe library in this setting. Highly stringent The SEQ ID NOs. of the variable regions of informative oligonucleotides from the 2000v1 and 2000v2 libraries are listed in Table 43. As above, the oligonucleotides were synthesized with a 5' region consisting of the sequence (5'-CTAGCATGACTGCAGTACGT (SEQ ID NO. 131)) and a 3' region consisting of the sequence (5'-CTGTCTCT-TATACACATCTGACGCTGCCGACGA (SEQ ID NO. 132)) flanking the variable regions. The listed oligonucleotides were used in the Random Forest modeling to generate AUC values, e.g., as shown in FIGS. 22A-D, and are listed in rank order. The row "Common" in Table 43 shows overlapping informative sequences from the 2000v1 and 2000v2 settings.

TABLE 43

Informative oligonucleotide probes

| Setting | SEQ ID NO. |
|---|---|
| 2000v1 | 1102, 624, 3032, 597, 2831, 1923, 706, 752, 1188, 238, 605, 2809, 651, 611, 2830, 1163, 1187, 1106, 421, 843, 1186, 1100, 1235, 3140, 173, 1243, 289, 178, 3035, 1080, 890, 1225, 1995, 508, 183, 435, 2584, 2795, 1814, 1924, 3075, 939, 1183, 431, 938, 1731, 1095, 446, 623, 1732, 3024, 216, 626, 672, 457, 830, 1497, 777, 610, 3038, 1460, 665, 1079, 148, 1445, 885, 1697, 1197, 1769, 965, 164, 838, 606, 3018, 493, 1830, 859, 2047, 1837, 404, 1693, 1201, 899, 264, 841, 1678, 1949, 628, 354, 1523, 3036, 495, 727, 1997, 676, 546, 1507, 615, 616, 3096, 1435, 1194, 1195, 698, 660, 1994, 1123, 290, 934, 428, 715, 751, 3064, 602, 345, 662, 1820, 586, 241, 929, 1136, 316, 803, 3095, 936, 1381, 537, 254, 1119, 1652, 1955, 1534, 2965, 496, 405, 757, 612, 145, 1248, 599, 942, 505, 907, 1353, 2786, 1509, 211, 1170, 736, 486, 815, 540, 1540, 1250, 3000, 2971, 348, 3108, 445, 1548, 1723, 888, 1284, 604, 858, 1372, 1083, 584, 767, 3135, 855, 2730, 805, 1557, 565, 1600, 920, 2330, 1977, 710, 1220, 1907, 441, 795, 1939, 1386, 908, 2986, 350, 552, 2953, 3134, 250, 765, 827, 1216, 526, 969, 1903, 693, 650, 1359, 789, 747, 826, 2002, 1291, 639, 1244, 573, 3119, 523, 594, 854, 898, 429, 1881, 569, 1538, 848, 738, 911, 669, 909, 329, 577, 2964, 272, 648, 1481, 1719, 816, 2981, 533, 2748, 1660, 3050, 755, 1706, 1504, 3059, 1276, 1547, 2732, 922, 2977, 2952, 1522, 1273, 1399, 1556, 2998, 853, 1256, 845, 625, 2005, 2987, 2985, 1327, 807, 923, 1500, 1331, 2497, 641, 1282, 1940, 629, 2970, 1150, 1915, 1862, 389, 1304, 2979, 3061, 1328, 2740, 819, 353, 396, 2983, 1164, 3029, 1566, 2041, 2972, 966 |
| 2000v2 | 4116, 171, 3280, 3401, 3879, 1175, 3291, 651, 3343, 592, 3110, 3682, 605, 3231, 3556, 389, 624, 399, 3173, 3483, 795, 3918, 211, 309, 3595, 4101, 3780, 1169, 803, 1392, 3332, 415, 3652, 1610, 3262, 163, 1477, 4044, 3319, 722, 3607, 3414, 564, 511, 826, 431, 4052, 3329, 692, 3153, 295, 1548, 635, 3900, 370, 3698, 342, 3545, 614, 178, 3699, 467, 3307, 770, 4055, 3912, 164, 3232, 4048, 2762, 3856, 2587, 421, 3683, 3000, 633, 3712, 3466, 3769, 3537, 4058, 4018, 2808, 4026, 3785, 4083, 3151, 1288, 4050, 3560, 3786, 1121, 3742, 3128, 4132, 1171, 3619, 3471, 566, 3751, 4110, 4091, 787, 1176, 3735, 538, 240, 3064, 2754, 3035, 199, 3777, 831, 1247, 1188, 3667, 3086, 3741, 3650, 1272, 3402, 3317, 3618, 1466, 1590, 3489, 3659, 1091, 3601, 4023, 1469, 1777, 2008, 4059, 1593, 4062, 205, 2838, 3087, 2835, 3661, 1661, 3551, 3612, 1322, 3629, 3789, 2017, 1325 |
| Common | 1188, 3064, 421, 624, 389, 803, 431, 826, 3035, 164, 178, 651, 3000, 1548, 211, 605, 795 |

The data presented in this Example demonstrate that an oligonucleotide pool comprising members having the variable regions listed in SEQ ID NOs 137-969 and 1072-4150, e.g., a pool of probes having the variable regions listed in Table 43, can be used to distinguish plasma from individuals having breast cancer versus plasma from non-breast cancer individuals.

Example 33: Photo-Cleavable Biotin Mediated Purification of an Oligonucleotide Library Tag probe and capture probe detection systems may have advantages in the read-out of oligonucleotide-based assays since such systems allow direct quantification of oligonucleotides without amplification. Amplification may introduce amplification bias, e.g., wherein some sequences are preferentially amplified versus others. One such system is the nCounter nucleic acid detection system from NanoString Technologies, Inc. (Seattle, Wash.). This system can be used to detect oligonucleotide probes of the invention. See, e.g., FIG. 14G and related discussion. Current applications of tag and capture probe detection systems include gene expression analysis, RNA:Protein analysis; single cell gene expression analysis; miRNA expression analysis, miRGE analysis, copy number variation analysis, lncRNA expression analysis; ChiP-String expression analysis. See, e.g., www.nanostring.com/applications/.

In this Example, we improved using the Nanostring system to detect the oligonucleotide probe libraries of the invention. As described above, a pre-enriched oligonucleotide probe library is contacted with a biological sample such as plasma, and microvesicles bound by various oligonucleotide probes are precipitated, e.g., with PEG. Thus, the oligonucleotide probe library is present in the mix with PEG/proteins. This mixture is compatible with PCR steps used for next-generation sequencing (NGS) preparation, but the Nanostring system may not detect probes in these mixtures. Without being bound by theory, this interference may be due to noted impurities with hybridization of the probes and other oligonucleotides used in purifications steps. We developed a protocol for purification of post-probing oligonucleotide probe library, which utilizes photocleavable (PC) Biotin (see, e.g., www.idtdna.com/site/Catalog/Modifications/Product/2291; references 1-4) and thus allows oligonucleotide probe detection using the Nanostring tag-capture system.

Figure 17A:
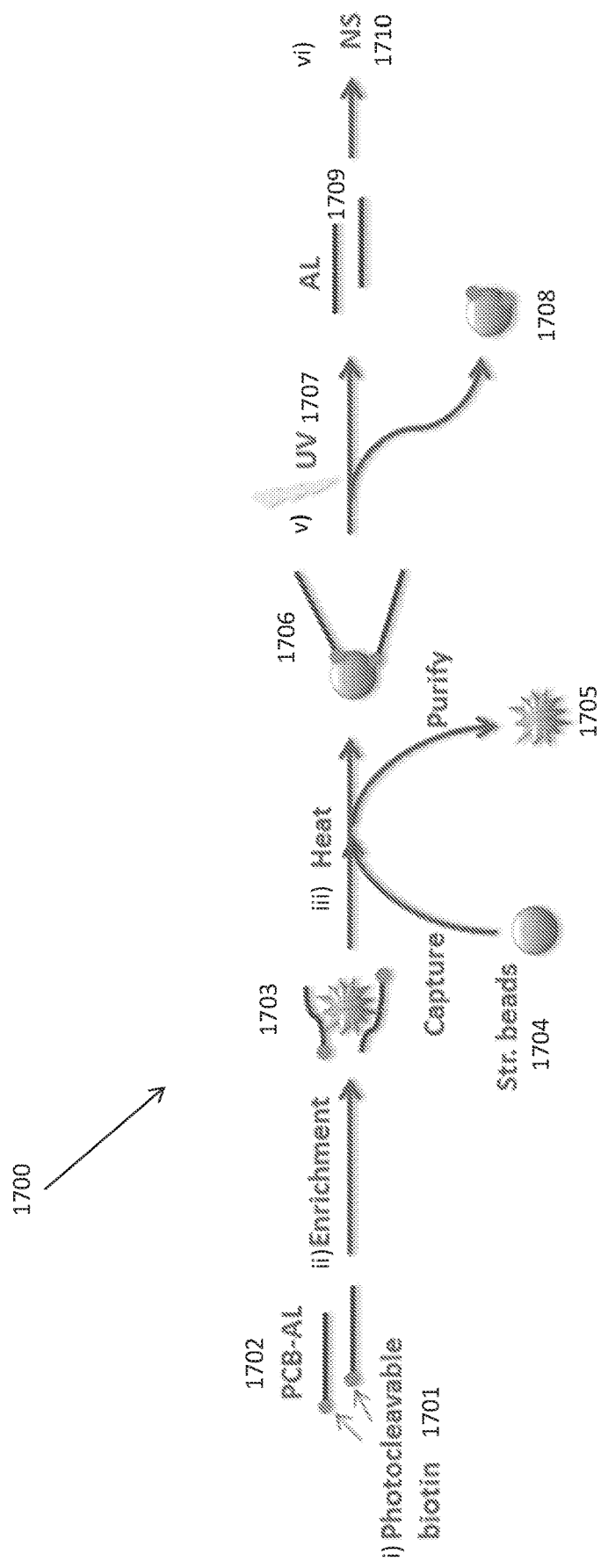

The steps of the purification of post-probing oligonucleotide probe library are shown in schematic 1700 in FIG. 17A and include the following: (i) modification of the 5'-end of each member of the oligonucleotide library with photocleavable-Biotin (PC-Biotin) 1701 via PCR with a PC-Biotinylated primer to create PC-Biotinylated aptamer library 1702; (ii) probing of plasma samples using the PC-Biotinyltated oligonucleotide probe library followed by PEG precipitation as described herein, resulting in a pellet 1703 which contains, inter alia, bound oligonucleotide library members, proteins and microvesicles 1705, and PEG; (iii) heat denaturing of the re-suspended pellet to break oligonucleotide/protein interactions and make PEG less viscous before mixing with streptavidin beads 1704; (iv) after short incubation with streptavidin beads 1704 to allow library 1702 to bind to the beads 1706, washing of the beads to remove impurities; (v) UV photo-cleavage 1707 of the spacer between the PC-Biotin and oligonucleotide molecules, capturing the beads 1708 using a magnet and collecting the released oligonucleotide library 1709 in the solution; and (vi) Nanostring 1710 sample preparation according to the manufacturer's instructions. In FIG. 17A, "PCB" refers to photocleavable biotin, oligonucleotide library members are referred to as "AL," "Str. Beads" refers to streptavidin beads, and "NS" refers to the Nanostring assay. The steps above are identified in the plot.

Figure 17B:
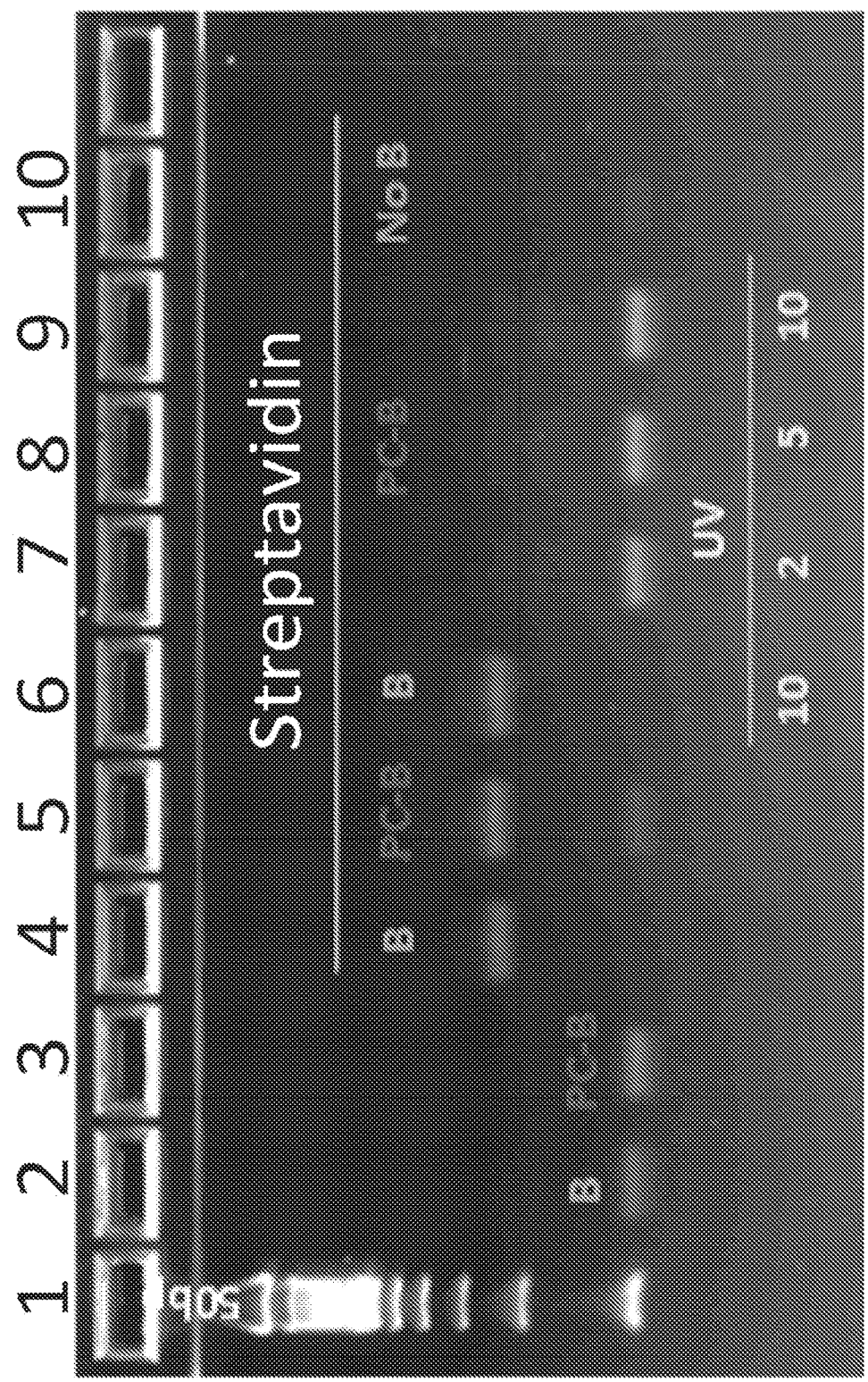
Figure 17C:
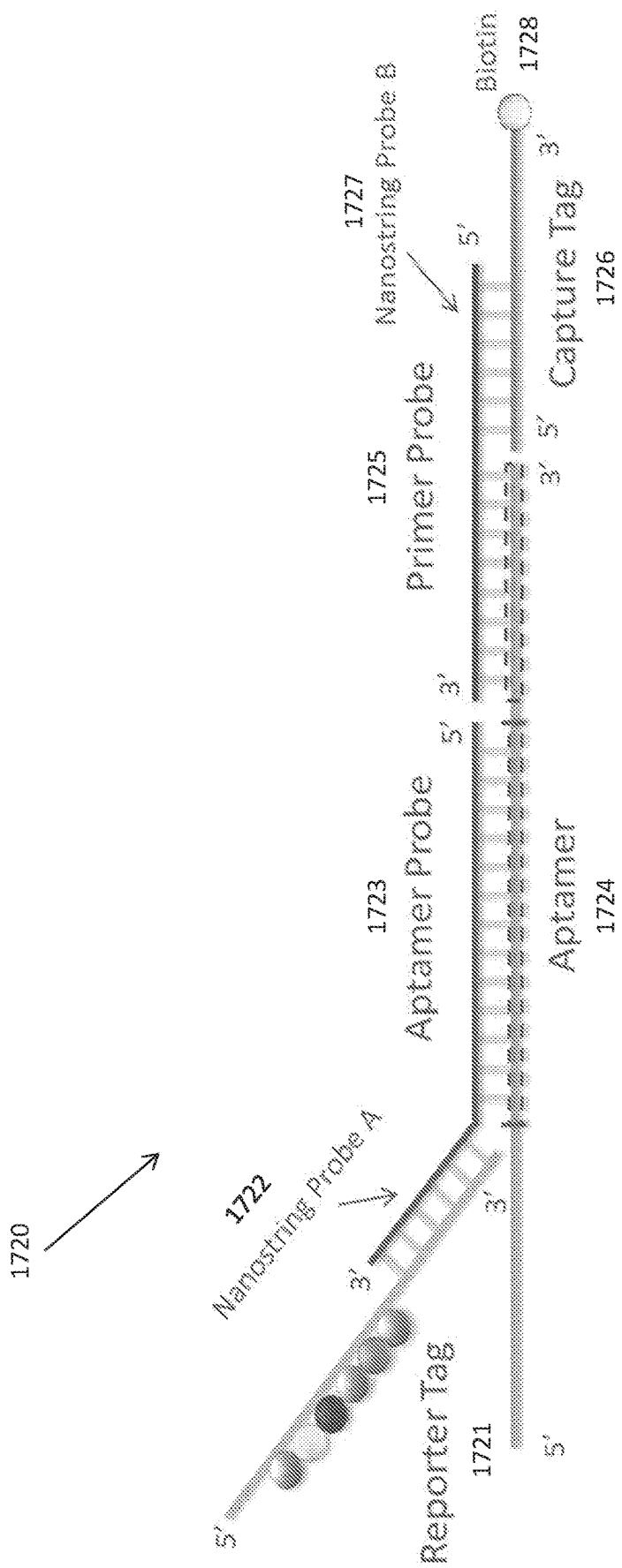

FIG. 17B show a 4% agarose gel with results of photocleavable biotin library cleavage test with Streptavidin protein. Lane 1 is a 50 bp DNA ladder and lane 10 is a Control with no biotin library with Streptavidin protein. The gel shows that both biotinylated ("B") and photo-cleavable biotinylated ("PC-B") modified oligonucleotides were bound to Streptavidin, which resulted in slower mobility in gel (lanes 4 and 5) as compared to the unbound oligonucleotides (lanes 2 and 3). After exposure to 365 nm UV radiation, the PC-B oligonucleotides were photo-cleaved, which resulted in faster mobility in gel and returning to the original molecular weight (i.e., before mixing with Streptavidin protein) (lanes 7-9, where minutes UV exposure are indicated). In contrast, no change to the B oligonucleotides was observed after 10 min exposure to UV (lane 8). These results demonstrate that the photocleavable biotin library can be captured by streptavidin beads and released by UV-mediated cleavage.

To test the workflow, a pool of plasma from patients with breast cancer and another pool of plasma from healthy donors were probed with an oligonucleotide library comprising 100 oligonucleotide probes, 50 of which were selected as cancer specific and other 50 were selected as equivalent binders to both types of samples (i.e., "neutral"). The Nanostring probe system 1720 was designed as in FIG. 17C. See FIG. 14G and description thereof for further details of the Nanostring probe system. The "Nanostring Probe A" 1722 and "Nanostring Probe B" 1727 were designed in part as reverse complements to the oligonucleotide probe library members of the invention (labeled "Aptamer" 1724 in the figure). As can be seen in FIGS. 17D-E, relevant Nanostring counts were obtained for the photocleavable oligonucleotide library (min relevant count is 300). Furthermore, the oligonucleotide probes selected as binders ("Binder") for the cancer pool ("CP"), indeed show stronger binding to the cancer pool as compared to counts from healthy pool ("HP"). The binding ratio between cancers and normal was ~5.25. For oligonucleotide probes selected as neutral binders ("Neutral"), there was no relevant difference between the cancer pool and healthy pool.

The Nanostring protocol uses hybridization of target specific probes. We tested 100 different oligonucleotide probes, which are complementary to portion of each specific oligonucleotide, as well as universal Primer probe for Nanostring detection using the above procedure. Following the standard Nanostring detection protocol, all probes were mixed with recovered and purified library, hybridized overnight and efficiently detected using the Nanostring tag-capture probe approach. In contrast, without purification no quantification of oligonucleotides with Nanostring was observed (data not shown).

In this Example, we established a process for oligonucleotide probe library purification after probing test samples. This process is efficient, low cost, can be accomplished in short time frame, and can be used for any purpose when library needs to be purified from probing product directly and quickly, given no biotin labeling is needed in downstream applications.

REFERENCES

1. Photocleavable biotin derivatives: a versatile approach for the isolation of biomolecules. Proc Natl Acad Sci USA. 1995, 16, 7590-7594.
2. Photocleavable biotin phosphoramidite for 5'-end-labeling, affinity purification and phosphorylation of synthetic oligonucleotides. Nucleic Acids Res. 1996, 2, 361-366.
3. Photocleavable affinity tags for isolation and detection of biomolecules. Methods Enzymol. 1998, 291, 135-154.
4. Matrix-assisted laser desorption/ionization mass spectrometry of DNA using photocleavable biotin. Biomol Eng. 1999, 16, 127-133.

Example 34: Single Stranded DNA (ssDNA) Oligonucleotide Library Preparation for Library Development The preparation of high yield and high quality ssDNA libraries is a critical step in SELEX (Systematic Evolution of Ligands by EXponential enrichment) [1, 2] as well as in other biological applications, such as DNA chips and microarrays [3], and single-stranded conformation polymorphism technique (SSCP) [4]. The standard approach for preparing ssDNA libraries includes PCR amplification to first generate a double stranded (dsDNA) library, followed by ssDNA separation and purification. Several strategies of ssDNA preparation have been developed to date, each with advantages and disadvantages:

Lambda Exonuclease Digestion [2, 5-7]

The dsDNA standard PCR product is followed by Lambda exonuclease to digest the complementary strand and leave the target ssDNA. ssDNA purification is then performed to remove enzymes and unwanted buffer.

Advantages: Regular PCR amplification has high yield in generating dsDNA.

Disadvantages: The purity of final ssDNA is limited by enzyme digestion efficiency. Also dsDNA needs to be purified prior to digestion, together with post-digestion purification there will be two purifications, which results in substantial loss of input material. The digestion usually requires at least 2 hours. The digestion rate may not be consistent.

Asymmetric PCR [8, 9]

The procedure generates target ssDNA as the main product and less dsDNA products and non-target ssDNA. The band corresponding to the target ssDNA is cut from a native gel.

Advantages: The final ssDNA product potentially has high purity.

Disadvantages: Separation of strands is possible in the native gel, but the yield is typically low and the presence of non-target strand cannot be excluded. The yield cannot be increased on denaturing gel because the strands have the same length.

Biotin-Streptavidin Magnetic Beads Separation [10, 11]

The non-target PCR primer is biotinylated so final PCR products are Biotinylated-dsDNA, which can be captured by streptavidin magnetic beads and denatured to release the non-biotin labeled target ssDNA.

Advantages: The final ssDNA product has relatively high purity.

Disadvantages: In most cases, the input library needs to be biotinylated, but it may be difficult to replace or release the captured target strands from streptavidin beads. Post-denaturing purification is required to remove NaOH and/or acid used for neutralization.

Unequal Primer Length PCR [12]

The non-target PCR primer has a chemical modified spacer and a few extra nucleotides following. In the PCR reaction, the DNA polymerase will stop at the spacer, resulting in unequal length of PCR dsDNA product. Then target ssDNA can be cut from a denaturing PAGE gel.

Advantages: The final ssDNA product has high purity because the target ssDNA is not mixed with non-target strands.

Disadvantages: ssDNA cannot be seen on native gel. Requires time consuming denaturing PAGE gel. It may be difficult to denature some dsDNA library, which can limit the final yield.

Indirect Purification Method [13]

The indirect purification strategy combines Asymmetric PCR and Biotin-streptavidin magnetic beads separation. In short, regular PCR is used to generate sufficient template, then asymmetric PCR with excess of target primer and less biotinylated complementary primers, followed by biotin-streptavidin separation.

Advantages: May increase yield and purity of ssDNA product.

Disadvantages: It cannot produce biotinylated target ssDNA library. The process is relatively long and complicated and may be prone to generate mutants of the original sequence.

The invention provides methods of enriching oligonucleotide probe libraries against a target of interest. As the probes may comprise ssDNA, the process may comprise PCR amplification then conversion back into ssDNA after each round of enrichment. In this Example, we developed a strategy for preparation of a ssDNA oligonucleotide library. The goals were to develop a process that is efficient and quick, while delivering high quality/purity ssDNA. We aimed to combine PCR and ssDNA prep in one step, remain efficient in the presence of selection buffer, target molecules, other sample components (e.g., highly abundant proteins for plasma samples) and other assay components (e.g., PEG precipitation solution that may be used to precipitate microvesicles). In addition, we desired the method to be able to generate ssDNA library with any modification, including without limitation Biotin.

We have used an optimized version of Lambda exonuclease digestion protocol for preparation of ssDNA oligonucleotide library. However, the digestion yield limits the overall recovery and is not consistent between different library preparations. In some cases, the ssDNA band is hardly visible on the gel following digestion. We have also observed incomplete digestion of dsDNA in the ssDNA product. In this Example, we developed an alternative protocol, termed "ssDNA by Unequal length PRimer Asymmetric PCR," or SUPRA. It lacks disadvantages from the known methods listed above, and provides high quality and yield up to 10× higher yield of ssDNA oligonucleotide library as compared to the previous methods. It is relatively fast and convenient technically, since target ssDNA can be distinguished from non-target DNA on a gel.

Figure 18A:
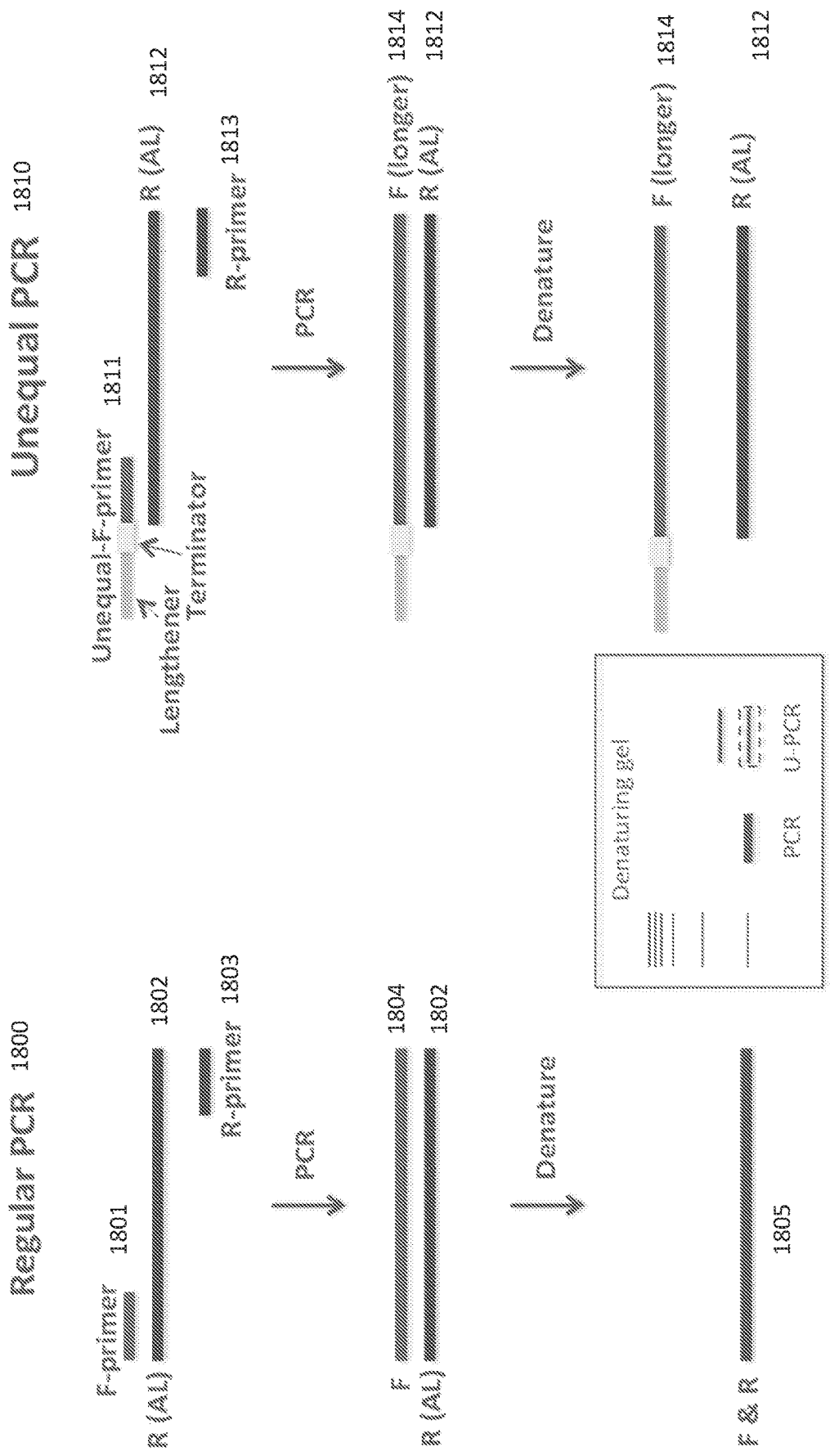
FIGS. 18A-C illustrate SUPRA (SsDNA by Unequal length PRimer Asymmetric PCR), a protocol for single stranded DNA (ssDNA) oligonucleotide library preparation.

A schematic comparing standard PCR 1800 and unequal length PCR 1810 is shown in FIG. 18A. In regular PCR 1800, a forward primer 1801 and reverse primer 1803 are hybridized with the reverse strand of an aptamer library 1802. The PCR reaction is performed, thereby creating equal length forward 1804 and reverse strands 1802. The strands are denatured in equal length single strands 1805. In unequal length PCR 1801, a forward primer 1811 a lengthener segment and terminator segment and a reverse primer 1813 are hybridized with the reverse strand of an aptamer library 1812. The PCR reaction is performed, thereby creating unequal length forward 1814 and reverse strands 1812. The strands are denatured into unequal length single strands 1814 and 1812 that can be separated by size, e.g., on a denaturing gel.

The steps of SUPRA include: (i) Modification of regular non-target primer with two Isp9 (Internal Spacer 9; triethylene glycol spacer) as terminator and 32 extra nucleotides (e.g., poly-A) as lengthener. It is referred as Unequal-Forward-Double isp9 primer (UF-D9); (ii) Perform asymmetric PCR, by mixing DNA template, UF-D9 and regular target (reverse) primer at ratio that favors the reverse primer, e.g., 1:37.5. The PCR program has longer elongation step (e.g., 3 min instead of standard 1 min) and more cycles due to linear amplification mode (instead of exponential). The PCR product contains a majority of target ssDNA and small portion of dsDNA. (iii) Mix PCR reaction products 1:1 with denaturing buffer (e.g., 180 mM NaOH and 6 mM EDTA) and denature samples by heating (e.g., 70° C. for 10 min) and cooling (e.g., incubation on ice for 3 min); (iv) Run denatured products in denaturing buffer on an agarose gel stained with SybrGold. The non-target strand, which is longer due to the lengthener, will appear as upper band (if visible) and the target strand (strong lower band) is cut and purified. The process can include optional steps, including without limitation: (v) Weigh the gel pieces and purify ssDNA from the gel pieces (e.g., using the ssDNA Nucleospin kit or the like); (vi) quantification of the yield and native gel can be used to check the purity and yield of final product (e.g., using the ssDNA Qubit kit or the like).

Figure 18B:
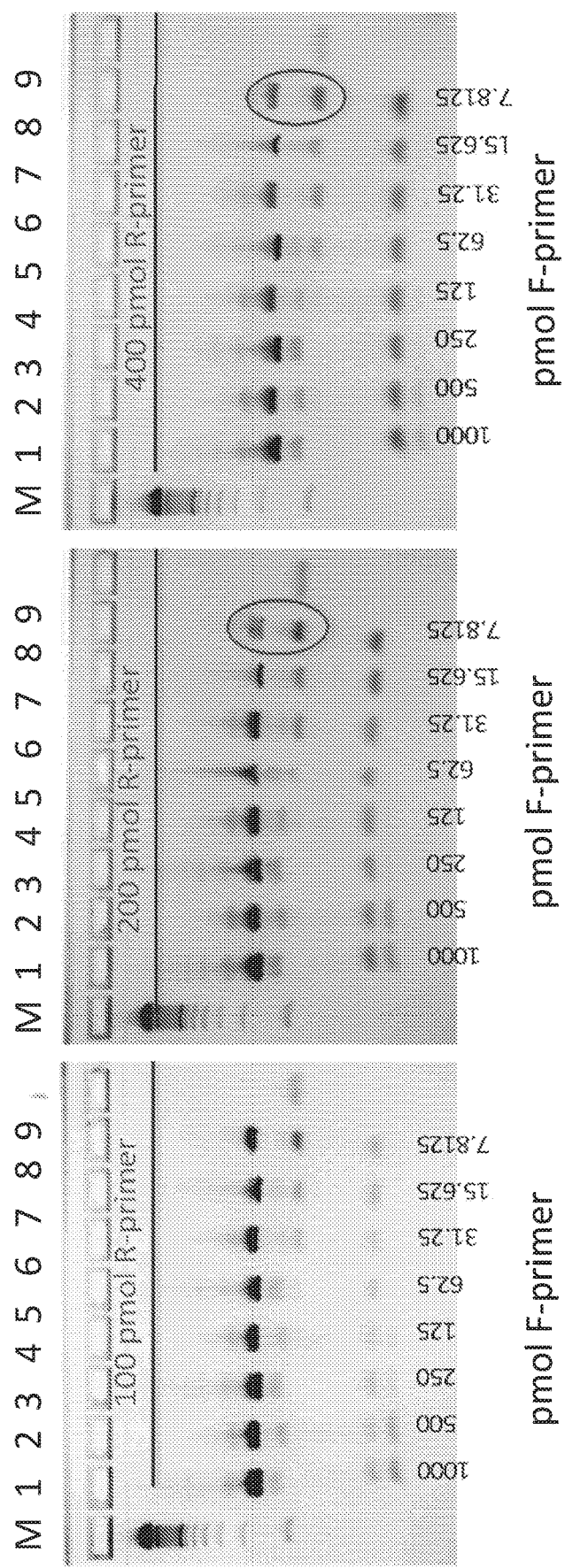

The first step (i) uses a specific design of the forward primer with efficient terminator and lengthener, which creates non-target strand of unequal length. The DNA polymerase used to build the target strand will stop polymerization once it reaches the terminator, and the lengthener facilitates differentiation between the target and non-target strands. In the second step (ii), the ratio between the two primers is shifted toward the reverse primer, to produce a majority of target ssDNA. The ratio, however, should not limit double strand templates production to keep reaction running FIG. 18B is a gel showing titration of forward and reverse primers input in asymmetrical PCR. The optimal condition, at which target strand is clearly visible, is in the range 1:20-1:50 F:R primers ratio. As shown in the figure, the ratio between two primers in asymmetric PCR can affect dsDNA and ssDNA amount in final products. The PCR thermocycler program is also adjusted to provide efficiency in the asymmetric PCR. In the third step (iii), a reliable denaturing method is used to separate target ssDNA to ensure the final yield and high purity.

As desired, the final step (vi) estimates the ratio of residual dsDNA, e.g., using ssDNA Qubit kit. In cases where the yield is not critical, the denaturing steps (iii and iv) can be skipped and the PCR products can be directly run on native gel. There will be a dsDNA band, but lower MW target ssDNA band can be distinguished and purified from gel. This is also a way to visualize the target band directly after PCR for a quality check or purification without denaturing. The purity of final product will be the same but yield will be lower.

Figure 18C:
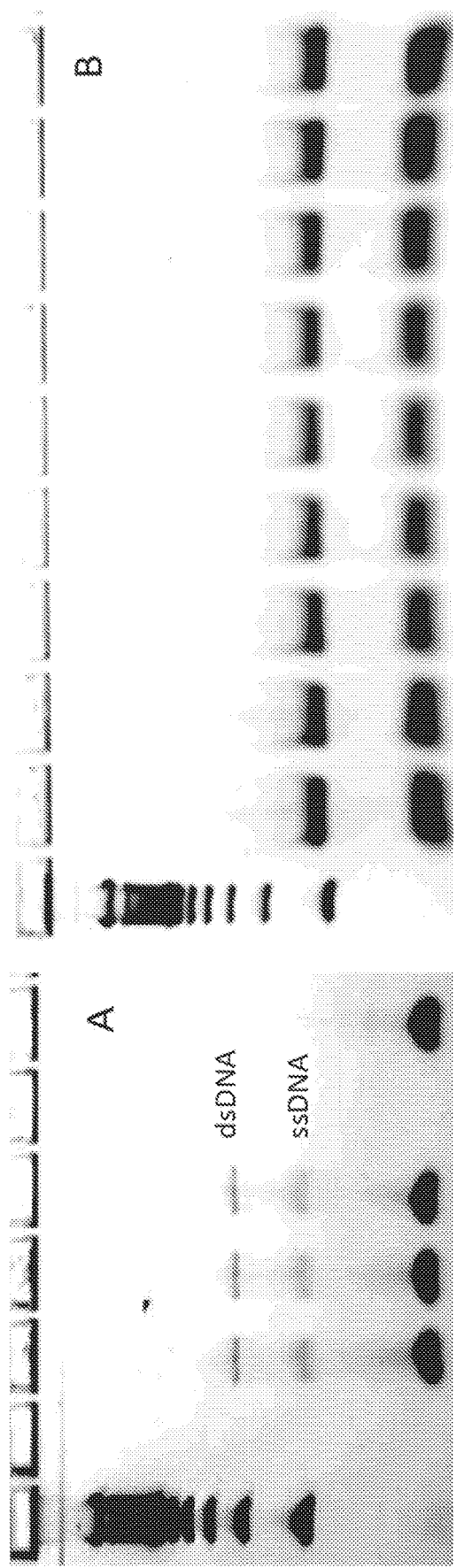

A comparison of native versus denatured gel purification is shown in FIG. 18C. A post-probing oligonucleotide probe library was PCRed using unequal length primers mixed at a ratio of 1:38 (Forward/Reverse). In the figure, the left lane on each gel is a 50 bp molecular weight ladder and the lower band is the reverse primer. The positions of the dsDNA and ss DNA are indicated. A native gel showed the presence of both dsDNA and ssDNA (target strand) (FIG. 18C, panel A). Here, part of the target reverse strand is migrating in dsDNA. Thus, using the native gel, one can purify target ssDNA with moderate recovery. When a higher yield is desired, the PCR products can be run on denaturing agarose gel as described above. This approach provides maximal recovery wherein only target strand is visible, and can be cut from gel and purified (FIG. 18C, panel B). In this case, the reverse strand ssDNA, which is part of the dsDNA on native gel (FIG. 18C, panel A), is denatured and migrates together with other free molecules of target ssDNA strand, while forward strand becomes invisible due to limited amplification.

Compared to standard asymmetric PCR, which has relatively low yield and does not allow to distinguish target and non-target strands on denaturing gel, SUPRA delivers different lengths of target and non-target that can be purified on both native gel and denaturing gels. Compared to unequal primer length PCR, which uses lengthy Urea-PAGE protocol and produces only dsDNA, SUPRA has less dsDNA and free target ssDNA can be cut even from native gel if yield is not critical.

SUPRA has been used in the oligonucleotide probe library enrichment methods provided by the invention. The method is robust. In the presence of enrichment buffer, target/non-target molecules, proteins, exosomes/microvesicles, PEG and other components, SUPRA provides high quality and quantity of the ssDNA oligonucleotide library.

REFERENCES

1. Comparison of different methods for generation of single-stranded DNA for SELEX processes. Anal. Bioanal. Chem. 2012, 404, 835-842.

2. Upgrading SELEX Technology by Using Lambda Exonuclease Digestion for Single-Stranded DNA Generation. Molecules 2010, 15, 1-11.

3. Tang, K.; Fu, D. J.; Julien, D.; Braun, A.; Cantor, C. R.; Koster, H. Chip-based genotyping by mass spectrometry. Proc. Natl. Acad. Sci. USA 1999, 96, 10016-10020.

4. Kuypers, A. W.; Linssen, P. C.; Willems, P. M.; Mensink, E. J. On-line melting of double-stranded DNA for analysis of single-stranded DNA using capillary electrophoresis. J. Chromatogr. B Biomed. Appl. 1996, 675, 205-211.

5. Higuchi, R. G.; Ochman, H. Production of single-stranded DNA templates by exonuclease digestion following the polymerase chain reaction. Nucleic Acids Res. 1989, 17, 5865.

6. Jones, L. A.; Clancy, L. E.; Rawlinson, W. D.; White, P. A. High-affinity aptamers to subtype 3a hepatitis C virus polymerase display genotypic specificity. Antimicrob. Agents Chemother. 2006, 50, 3019-3027.

7. S. S. Oh, K. Ahmads, M. Cho, Y. Xiao, H. T. Soh, "Rapid, Efficient Aptamer Generation: Kinetic-Challenge Microfluidic SELEX," presented in the 12th Annual UC Systemwide Bioengineering Symposium, Jun. 13~15, 2011, Santa Barbara, U.S.A.

8. Gyllensten, U. B.; Erlich, H. A. Generation of single-stranded DNA by the polymerase chain reaction and its application to direct sequencing of the HLA-DQA locus. Proc. Natl. Acad. Sci. USA 1988, 85, 7652-7656.

9. Wu, L.; Curran, J. F. An allosteric synthetic DNA. Nucleic Acids Res. 1999, 27, 1512-1516.

10. Espelund, M.; Stacy, R. A.; Jakobsen, K. S. A simple method for generating single-stranded DNA probes labeled to high activities. Nucleic Acids Res. 1990, 18, 6157-6158.

11. A. Paul, M. Avci-Adali, G. Ziemer, H. P. Wendel. Streptavidin-coated magnetic beads for DNA strand separation implicate a multitude of problems during cell-SELEX. Oligonucleotides 2009, 19, 243-254.

12. Williams K., Bartel D. PCR product with strands of unequal length. Nucleic Acids Research, 1995, Vol. 23, No. 20.

13. Indirect purification method provides high yield and quality ssDNA sublibrary for potential aptamer selection. Anal. Biochem. 2015, online available.

Example 35: Anti-C1q Oligonucleotides

This Example presents identification of anti-C1q aptamers. In this Example, biotinylated forms of the oligonucleotides identified in Example 27 were synthesized and immobilized to streptavidin beads and incubated with the PEG precipitated plasma fraction. Proteins that immunoprecipitated with oligonucleotides from SEQ ID NO. 1472-1486 were separated by SDS-PAGE. Specific bands were excised from the gel and proteins therein identified by in-gel trypsin digestions and LC-MS/MS such as in Example 23 above.

Immunoprecipitation of specific oligonucleotides conjugated to magnetic beads was performed to identify oligonucleotide targets. Several oligonucleotides were identified that recognized C1q and subunits. The sequences of the variable regions of identified anti-C1q aptamers include 5'-ACTATAGAACAATCCACCGCTTTAAATCAAC-TATCTTA (SEQ ID NO. 1472), also known by the identifier 83S-B1; 5'-TACCCCTGACAATCCTCGCGCCGAGGC-CTCCATCCTGA (SEQ ID NO. 1475), also known by the identifier 83S-B4; 5'-GATTTTAAAACCCTTGCACCT-GATTGTGCCAATCCA (SEQ ID NO. 1477), also known by the identifier 83S-B6; and 5'-AACCCAATTCACATA-CACTCTCACCCCCACTAAACA (SEQ ID NO. 1482), also known by the identifier 83S-B11. Of note, the variable regions of 83S-B1 and 83S-B4 share the motif 5'-ACAATCC (SEQ ID NO. 4151), suggesting that this may comprise a consensus sequence that facilitates binding to C1q. Further as noted below, an oligonucleotide comprising the reverse complement of this putative consensus sequence did not bind C1q. Several variants of the anti-C1q aptamers were also identified in the experiments of Example 27. The sequences of the variable regions thereof are shown in Table 44. As above, the full length oligonucleotide probes in Table 44 each had a 5' region consisting of the sequence (5'-CTAGCATGACTGCAGTACGT (SEQ ID NO. 131)) and a 3' region consisting of the sequence (5'-CTGTCTCTTATA-CACATCTGACGCTGCCGACGA (SEQ ID NO. 132)). Table 44 shows the variable region that is positioned between the 5' and 3' regions of the sequences.

TABLE 44

Anti-C1q Variable Regions

| Variable Region | SEQ ID NO. |
|---|---|
| 83S-B1 (SEQ ID NO. 1472) and variants below | |
| ACTATAGAACAATCCACCGCTTTAAATCAACTATCTTA | 1472 |
| ACTATAGAACAATCCACCGCTTTAAATCAACTATCTGA | 4152 |
| ACTATAGAACAATCCACCGCTTTAAATCAACTATCTCA | 4153 |
| ACTATAGAACAATCCACCGCTTTAAATCAACTATCTAA | 4154 |
| ACTATAGAACAATCCACCGCTTTAAATAAACTATCTGA | 4155 |
| ACTATAGAACAATCCACCTCTTTAAATCAACTATCTGA | 4156 |
| ACTATAGAACAATCCACCGCTTTAAATCAACTATCCGA | 4157 |
| AATATAGAACAATCCACCGCTTTAAATCAACTATCTGA | 4158 |
| ACTATAGAACAATCCACCGCTTTAAATCAACTATCCTA | 4159 |
| ACTATAGAACAATCCACCTCTTTAAATCAACTATCTTA | 4160 |
| ACTATAGAACAATCCCCCGCTTTAAATCAACTATCTGA | 4161 |
| ACTATAGAACAATCCGCCGCTTTAAATCAACTATCTGA | 4162 |
| ACTATAGAACAATCCTCCGCTTTAAATCAACTATCTGA | 4163 |
| ACTATATAACAATCCACCGCTTTAAATCAACTATCTGA | 4164 |
| 83S-B4 (SEQ ID NO. 1475) and variants below | |
| TACCCCTGACAATCCTCGCGCCGAGGCCTCCATCCTGA | 1475 |
| TACCCCTGACAATCCTCGCGCCGAGGCCTCCATCCTCA | 1485 |
| TACCCCTGACAATCCTCGCGCCGAGGCCTCCATCCTCA | 4165 |
| TACCCCTGACAATCCTCGCGCCGAGGCCTCCATCCTAA | 4166 |
| 83S-B6 (SEQ ID NO. 1477) and variants below | |
| GATTTTAAAACCCTTGCACCTGATTGTGCCAATCCA | 1477 |
| GATTTTAAAACCCTTGCACCTGATTGTGCCAATCAA | 4167 |
| GATTTTAAAACCCTTGCACCTGATTGTGCCAATCGA | 4168 |
| GATTTTAAAACCCTTGCACCTGATTGTGCCAATCTA | 4169 |
| 83S-B11 (SEQ ID NO. 1482) and variants below | |
| AACCCAATTCACATACACTCTCACCCCCACTAAACA | 1482 |
| AACCCAATTCACATACACTCTCACCCTCACTAAACA | 4170 |
| AACCCAATTCACATACACTCTCACCCTCACTAAAAA | 4171 |
| AACCCAATTCACATACACTCTCACCCTCACTAAAGA | 4172 |
| AACCCAATTCACATACACTCTCACCCTCACTAAATA | 4173 |
| AACCCAATTCACATACACTCTCACCCTCACTAACCA | 4174 |
| AACCCAATTCACATACACTCTCACCCTCACTAACAA | 4175 |
| AACCCAATTCACATACACTCTCTCCCTCACTAAACA | 4176 |
| AACCCAATTCACATACACTCTCCCCCTCACTAAACA | 4177 |
| AACCCAATTCACATACACTCTCGCCCTCACTAAACA | 4178 |

TABLE 44-continued

Anti-C1q Variable Regions

| Variable Region | SEQ ID NO. |
|---|---|
| AACCCAATTCACATACTCTCTCACCCTCACTAAACA | 4179 |
| AACCCAATTCACATAAACTCTCACCCTCACTAAACA | 4180 |
| AACCCAATCCACATACACTCTCACCCTCACTAAACA | 4181 |
| AACCCAATTCACATACACTCTCACCCTCACTAAACC | 4182 |
| AACCCAATTCACATACGCTCTCACCCTCACTAAACA | 4183 |
| AACCCAATTCACATACACTCTCTCCCTCACTAAAAA | 4184 |
| AACCCAATTCACATACACCCCTCACCCTCACTAAACA | 4185 |
| AACCCAATTCACATACACTCTCGCCCTCACTAAAAA | 4186 |
| AACCCAATTCACATACACTCTTACCCTCACTAAACA | 4187 |
| AACCCAATACACATACACTCTCACCCTCACTAAACA | 4188 |
| AACCCAATTCACATACACTCTCACCCTCTCTAAACA | 4189 |
| AACCCAATTCACATACACTCTCCCCCTCACTAAAAA | 4190 |
| AACCCAATTCACATACCCTCTCACCCTCACTAAAAA | 4191 |
| AACCCAATTCACATACACTCTCACCCTCACTAAACT | 4192 |
| AACCCAATTCACATACACCCCTCACCCTCACTAAACA | 4193 |
| AACCCAATTCACATACTCTCTCACCCTCACTAAAAA | 4194 |
| AACCCAATGCACATACACTCTCACCCTCACTAAACA | 4195 |
| AGCCCAATTCACATACACTCTCACCCTCACTAAACA | 4196 |
| AACCCAATTCACATACACTCTAACCCTCACTAAACA | 4197 |
| AACCCAAATCACATACACTCTCACCCTCACTAAACA | 4198 |
| AACCCAATTCACATACACTCTCACCCTCACTAAAAT | 4199 |
| AACCCAATTCACATACACTCTCTCCCTCACTAAAGA | 4200 |
| AACCCAATTCTCATACACTCTCACCCTCACTAAACA | 4201 |
| ATCCCAATTCACATACACTCTCACCCTCACTAAACA | 4202 |
| AACCCAACTCACATACACTCTCACCCTCACTAAACA | 4203 |
| AACCCAATTCACATACACTCTCACCCTCACTAAAAC | 4204 |
| AACCCAATTCACATACACTCTCACCCTCACTAACTA | 4205 |
| AACCCAATTCACATACACTCTCGCCCTCACTAAAGA | 4206 |
| AACCCAATTCACATTCACTCTCACCCTCACTAAACA | 4207 |
| AACCCAAATTCACATACACTCTCACCCTCACTAAACA | 4208 |
| AACCCAATTCACATAAACTCTCACCCTCACTAAAAA | 4209 |
| AACCCAATTCACATACACGCTCACCCTCACTAAACA | 4210 |
| AACCCAATTCACATACACTCTCACACTCACTAAACA | 4211 |
| AACCCAATTCACATACACTCTCACCATCACTAAACA | 4212 |
| AACCCAATTCACATACACTCTCACCCTCACTAACGA | 4213 |
| AACCCAATTCACATACACTCTCACCCTCGCTAACA | 4214 |
| AACCCAATTCACATACACTCTCCCCCTCACTAAAGA | 4215 |
| AACCCAATTCGCATACACTCTCACCCTCACTAAACA | 4216 |
| AACCCAATTCACATACACTCACACCCTCACTAAACA | 4217 |
| AACCCAATTCACATACACTCTCCCACTCACTAAACA | 4218 |
| AACCCAATTCACATACACTCTCACCCTCACTAAACG | 4219 |
| AACCCAATTCACATACTCTCTCACCCTCACTAAAGA | 4220 |
| AACCCAATTCACATACTCTCTCACCCTCACTAAATA | 4221 |
| AACCCAGTTCACATACACTCTCACCCTCACTAAACA | 4222 |
| AAACCAATTCACATACACTCTCACCCTCACTAAACA | 4223 |
| AACACAATTCACATACACTCTCACCCTCACTAAACA | 4224 |
| AACCCAACTCACATACACTCTCACCCTCACTAAAAA | 4225 |
| AACCCAAGTCACATACACTCTCACCCTCACTAAACA | 4226 |
| AACCCAATCCACATACACTCTCACCCTCACTAAAAA | 4227 |
| AACCCAATTAACATACACTCTCACCCTCACTAAACA | 4228 |
| AACCCAATTCACAAACACTCTCACCCTCACTAAACA | 4229 |
| AACCCAATTCACACACTCTCACCCCCCACTAAACA | 4230 |
| AACCCAATTCACACACACTCTCACCCTCACTAAACA | 4231 |
| AACCCAATTCACACACACTCTCCCCCTCACTAAACA | 4232 |
| AACCCAATTCACAGACACTCTCACCCTCACTAAACA | 4233 |
| AACCCAATTCACATACAATTCACCCTCACTAAACA | 4234 |
| AACCCAATTCACATACACACTCACCCTCACTAAACA | 4235 |
| AACCCAATTCACATACACCCTCACCCTCACTAAAAA | 4236 |
| AACCCAATTCACATACACTATCACCCTCACTAAAAA | 4237 |
| AACCCAATTCACATACACTATCACCCTCACTAAACA | 4238 |
| AACCCAATTCACATACACTCCCCACCCTCACTAAACA | 4239 |
| AACCCAATTCACATACACTCCGCACCCTCACTAAACA | 4240 |
| AACCCAATTCACATACACTCTCAACCTCACTAAACA | 4241 |
| AACCCAATTCACATACACTCTCACACTCACTAAAAA | 4242 |
| AACCCAATTCACATACACTCTCACCATCCCTAAACA | 4243 |
| AACCCAATTCACATACACTCTCACCCACACTAAACA | 4244 |
| AACCCAATTCACATACACTCTCACCCGCACTAAACA | 4245 |
| AACCCAATTCACATACACTCTCACCCTAACTAAACA | 4246 |
| AACCCAATTCACATACACTCTCACCCTCCAATAAACA | 4247 |
| AACCCAATTCACATACACTCTCACCCTCACCAAACA | 4248 |
| AACCCAATTCACATACACTCTCACCCTCACTAAAAG | 4249 |
| AACCCAATTCACATACACTCTCACCCTCACTAAAGC | 4250 |
| AACCCAATTCACATACACTCTCACCCTCACTAAAGT | 4251 |
| AACCCAATTCACATACACTCTCACCCTCACTAAATC | 4252 |

TABLE 44-continued

Anti-C1q Variable Regions

| Variable Region | SEQ ID NO. |
|---|---|
| AACCCAATTCACATACACTCTCACCCTCACTAAATT | 4253 |
| AACCCAATTCACATACACTCTCACCCTCACTAAGAA | 4254 |
| AACCCAATTCACATACACTCTCACCCTCACTAAGCA | 4255 |
| AACCCAATTCACATACACTCTCACCCTCACTAAGGA | 4256 |
| AACCCAATTCACATACACTCTCACCCTCACTAAGTA | 4257 |
| AACCCAATTCACATACACTCTCACCCTCACTAATAA | 4258 |
| AACCCAATTCACATACACTCTCACCCTCACTAATCA | 4259 |
| AACCCAATTCACATACACTCTCACCCTCACTAATGA | 4260 |
| AACCCAATTCACATACACTCTCACCCTCACTAATTA | 4261 |
| AACCCAATTCACATACACTCTCACCCTCACTACACA | 4262 |
| AACCCAATTCACATACACTCTCACCCTCACTAGACA | 4263 |
| AACCCAATTCACATACACTCTCACCCTCACTATACA | 4264 |
| AACCCAATTCACATACACTCTCACCCTCACTCAACA | 4265 |
| AACCCAATTCACATACACTCTCACCCTCACTGAACA | 4266 |
| AACCCAATTCACATACACTCTCACCCTCACTTAACA | 4267 |
| AACCCAATTCACATACACTCTCACCCTCATTAAACA | 4268 |
| AACCCAATTCACATACACTCTCACCCTCCCTAAAAA | 4269 |
| AACCCAATTCACATACACTCTCACCCTCCCTAAACA | 4270 |
| AACCCAATTCACATACACTCTCACCCTCCCTAAAGA | 4271 |
| AACCCAATTCACATACACTCTCACCCTCCCTAAATA | 4272 |
| AACCCAATTCACATACACTCTCACCCTCGCTAAAAA | 4273 |
| AACCCAATTCACATACACTCTCACCCTCTCTAAAAA | 4274 |
| AACCCAATTCACATACACTCTCACCCTCTGACTAAACA | 4275 |
| AACCCAATTCACATACACTCTCACCCTTACTAAACA | 4276 |
| AACCCAATTCACATACACTCTCACCTTCACTAAACA | 4277 |
| AACCCAATTCACATACACTCTCACCTTCTCTAAACA | 4278 |
| AACCCAATTCACATACACTCTCACGCTCACTAAACA | 4279 |
| AACCCAATTCACATACACTCTCACTCTCACTAAAAA | 4280 |
| AACCCAATTCACATACACTCTCACTCTCACTAAACA | 4281 |
| AACCCAATTCACATACACTCTCAGCCTCACTAAACA | 4282 |
| AACCCAATTCACATACACTCTCATCCTCACTAAACA | 4283 |
| AACCCAATTCACATACACTCTCCCCCCTCACTAAATA | 4284 |
| AACCCAATTCACATACACTCTCGCCCTCACTAAATA | 4285 |
| AACCCAATTCACATACACTCTCTCCCTCACTAAATA | 4286 |
| AACCCAATTCACATACACTGTCACCCTCACTAAACA | 4287 |
| AACCCAATTCACATACACTTTCACCCTCACTAAACA | 4288 |
| AACCCAATTCACATACATTCTCACCCTCACTAAACA | 4289 |
| AACCCAATTCACATACCCTCTCACCCTCACTAAAGA | 4290 |
| AACCCAATTCACATACGCTCTCACCCTCACTAAAAA | 4291 |
| AACCCAATTCACATACGCTCTCACCCTCACTAAAGA | 4292 |
| AACCCAATTCACATATACTCTCACCCTCACTAAAAA | 4293 |
| AACCCAATTCACATATACTCTCACCCTCACTAAACA | 4294 |
| AACCCAATTCACATCCACTCTCACCCTCACTAAACA | 4295 |
| AACCCAATTCACATGCACTCTCACCCTCACTAAACA | 4296 |
| AACCCAATTCACCTACACTCTCACCCTCACTAAAAA | 4297 |
| AACCCAATTCACCTACACTCTCACCCTCACTAAACA | 4298 |
| AACCCAATTCACGTACACTCTCACCCTCACTAAACA | 4299 |
| AACCCAATTCACTTACACTCTCACCCTCACTAAACA | 4300 |
| AACCCAATTCAGATACACTCTCACCCTCACTAAACA | 4301 |
| AACCCAATTCATATACACTCTCACCCTCACTAAAAA | 4302 |
| AACCCAATTCATATACACTCTCACCCTCACTAAACA | 4303 |
| AACCCAATTCCCATACACTCTCACCCTCACTAAACA | 4304 |
| AACCCAATTTACATACACTCTCACCCTCACTAAACA | 4305 |
| AACCCACTTCACATACACTCTCACCCTCACTAAACA | 4306 |
| AACCCATTTCACATACACTCTCACCCTCACTAAACA | 4307 |
| AACCCCATTCACATACACTCTCACCCTCACTAAAAA | 4308 |
| AACCCCATTCACATACACTCTCACCCTCACTAAACA | 4309 |
| AACCCGATTCACATACACTCTCACCCTCACTAAACA | 4310 |
| AACCCTATTCACATACACTCTCACCCTCACTAAAAA | 4311 |
| AACCCTATTCACATACACTCTCACCCTCACTAAACA | 4312 |
| AACCGAATTCACATACACTCTCACCCTCACTAAACA | 4313 |
| AACCTAATTCACATACACTCTCACCCTCACTAAAAA | 4314 |
| AACCTAATTCACATACACTCTCACCCTCACTAAACA | 4315 |
| AACTCAATTCACATACACTCTCACCCTCACTAAACA | 4316 |
| AATCCAATTCACATACACTCTCACCCTCACTAAACA | 4317 |
| ACCCCAATTCACATACACTCTCACCCTCACTAAAAA | 4318 |
| ACCCCAATTCACATACACTCTCACCCTCACTAAACA | 4319 |
| AGCCCAATTCACATACACTCTCACCCTCACTAAAAA | 4320 |
| ATCCCAATTCACATACACTCTCACCCTCACTAAACA | 4321 |
| CACCCAATTCACATACACTCTCACCCTCACTAAAAA | 4322 |
| CACCCAATTCACATACACTCTCACCCTCACTAAACA | 4323 |
| GACCCAATTCACATACACTCTCACCCTCACTAAACA | 4324 |
| TACCCAATTCACATACACTCTCACCCTCACTAAACA | 4325 |

Specificity for C1q as a target was performed by immunoprecipitation of C1q depleted or spiked serum and plasma samples. SDS-PAGE analysis of the immunoprecipitation products demonstrated that bands corresponding to C1q subunits (i.e., A, B, C) were only present in the samples spiked with C1q. As a control, oligonucleotides comprising the reverse complements to SEQ ID NOs. 1472 and 1482 were synthesized. For example, the construct comprising the reverse complement to SEQ ID NOs. 1472 comprised the variable region sequence 5'-TTAAGATAGTTGATT-TAAAGCGGTGGATTGTTCTATAGT (SEQ ID NO. 4326).

Figure 24A:
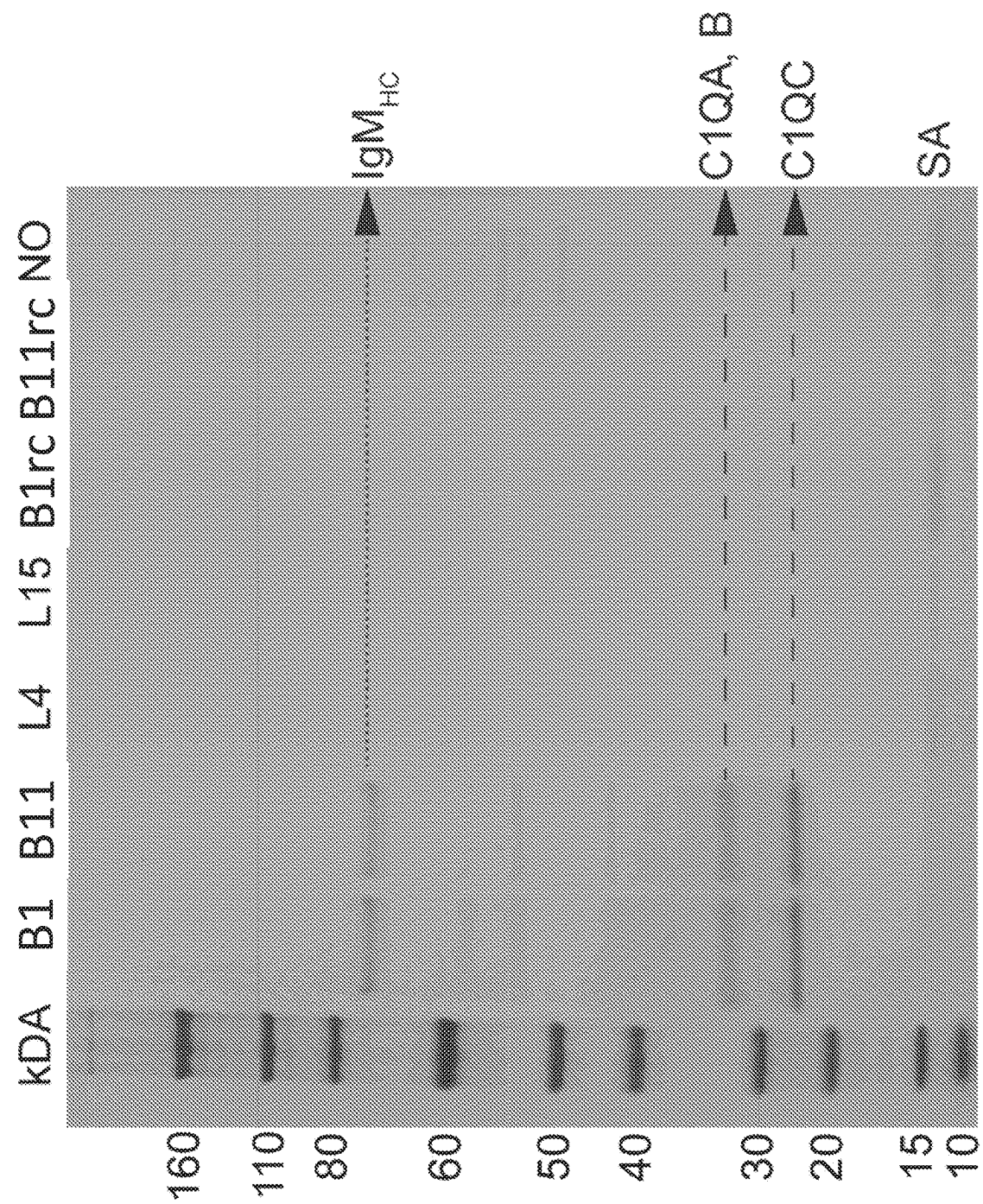
FIGS. 24A-C illustrate identification of oligonucleotides that recognize C1q and other targets.

FIG. 24A shows a silver-stained reducing sodium dodecyl sulfate-polyacrylamide (SDS-PA) gel of immunoprecipitated proteins from plasma samples with the indicated oligonucleotides. In the figure, B1 comprises the variable region SEQ ID NO. 1472, B11 comprises the variable region SEQ ID NO. 1482, and L4 and L15 comprises variable regions without specific recognition of C1q. The individual biotinylated oligonucleotides were immobilized on streptavidin magnetic beads, contacted with PEG-precipitated plasma isolates from a pool of healthy donors, and the beads were isolated. Proteins that immunoprecipitated with the beads are shown on the gel. Controls included the reverse complements of B1 and B11 (lanes B1rc and B11rc, respectively) and a control using beads without oligonucleotides (Lane "NO"). Dashed arrows indicate pulled down proteins C1qA, C1qB, and C1qC. The dotted arrow indicates the heavy chain of IgM (IgMHC). The band labeled "SA" is streptavidin and the lane kDa is a protein ladder. As shown in FIG. 24A, specific bands indicated by the dashed arrows were observed in the B1 and B11 immunoprecipitation experiments. These bands were excised and analyzed by LC-MS/MS. This analysis revealed the complement protein complex C1q as the target of sequences B1 and B11, and the figure indicates the positions of C1q subunits A, B and C. In contrast, reverse complement versions of B1 and B11 (i.e., B1rc, B11rc) did not immunoprecipitate C1q. Also shown in the figure, IgM co-precipitated with C1q. Without being bound by theory, these findings are consistent with previous observations where IgM was found to remain complexed with C1q in sera that were precipitated with PEG. See Krieger, et al. Characterization of immune complexes detected by the 125I-C1q binding assay in breast cancer. Clin Immunol Immunopathol 46, 14-23 (1988); which publication is incorporated by reference herein in its entirety.

Figure 24B:
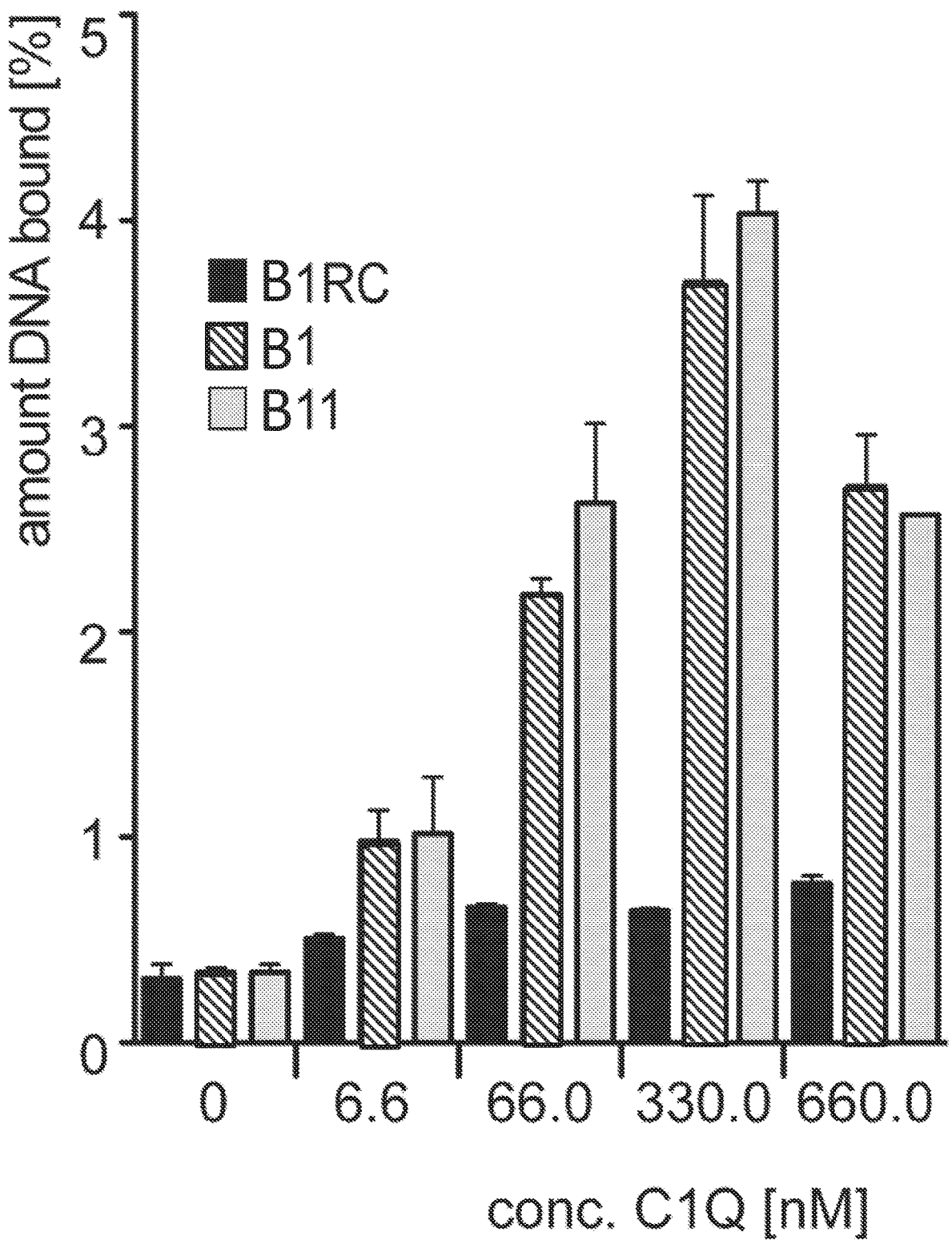
Figure 24C:
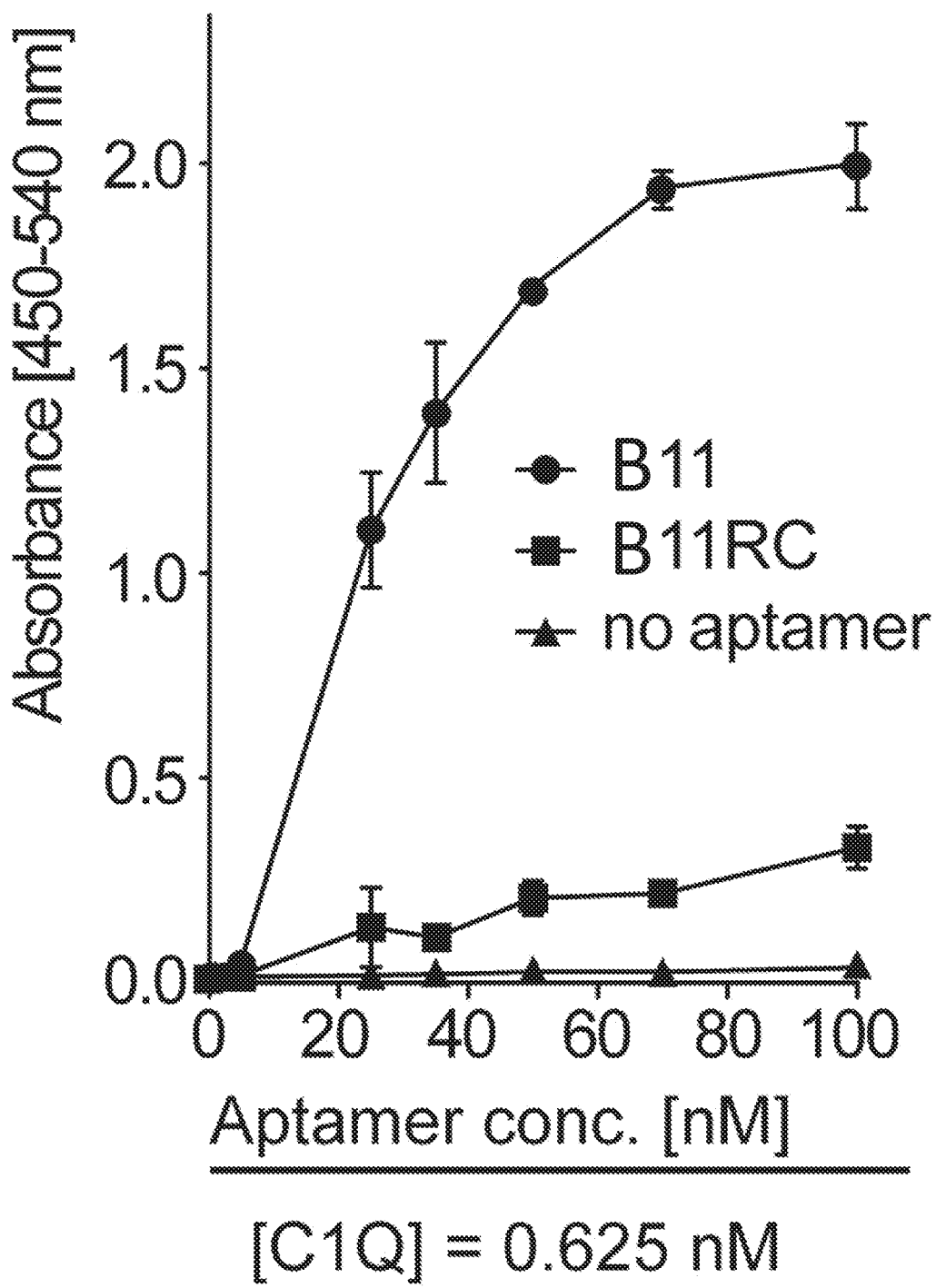

To further investigate the interaction of aptamer B1 and B11 with C1q, we performed a filter retention assay. Radioactively labelled B1 and B11 were incubated with increasing concentrations of purified C1q and subsequently passed through a nitrocellulose membrane. The amount of oligonucleotides retained on membrane-immobilized C1q was then quantified by autoradiography. Results are shown in FIG. 24B. These experiments demonstrate that B1 and B11 exhibit concentration dependent binding to C1q, whereas B11rc did not. Similar results were obtained with B11 and B11rc in an Enzyme-Linked Oligonucleotide Assay (ELONA; see U.S. Pat. No. 5,789,163, which patent is incorporated herein in its entirety). See FIG. 24C. The figure shows ELONA analysis of B11 (circles) at indicated concentrations and a fixed C1q concentration (0.625 nM). As a control, the reverse complement of B11, B11RC, was used (squares). "No aptamer" control (triangles) shows low background binding of detector Streptavidin-HRP. B11 specifically binds C1q (estimated $K_D$ around 40 nM). This binding behaviour indicates that B1 and B11 specifically interact with C1q with high affinity.

A second control comprised the reverse complement to the consensus motif (i.e., SEQ ID NO. 4151). This construct comprised the variable region sequence 5'-TACTATA-GATGGATTGTCCGCTTTAAATCAACTATCTTA (SEQ ID NO. 4327) and did not immunoprecipitate C1q from plasma.

Table 45 lists proteins that were identified in the immunoprecipitation with B1 (i.e., SEQ ID NO. 1472) using PSMs (peptide spectrum matches) sorted by area. The proteins in the list were observed only in the immunoprecipitation with B1 (i.e., not observed with negative controls) or at levels at least 2-fold over negative controls. The mass spectrometry results were obtained from a single band that was run a short distance in a gel in order to clean up the sample. Accession numbers in the table are from the UniProt database (www.uniprot.org). "GN=" is followed by the gene name. As seen in Table 45, C1q subunits A-C were prominent in the results. IgM was also observed at high levels. Without being bound by theory, this may be due to complexes between C1q and immunoglobulins as noted above. Complement C4b-binding protein alpha chain was also observed at 10-fold higher levels versus controls.

TABLE 45

Oligonucleotide probe targets

| Accession number | Protein name |
|---|---|
| P02747 | Complement C1q subcomponent subunit C GN = C1QC |
| P02746 | Complement C1q subcomponent subunit B GN = C1QB |
| P01871 | Ig mu chain C region GN = IGHM |
| P04220 | Ig mu heavy chain disease protein |
| P02745 | Complement C1q subcomponent subunit A GN = C1QA |
| P01834 | Ig kappa chain C region GN = IGKC |
| P0CG05 | Ig lambda-2 chain C regions GN = IGLC2 |
| B9A064 | Immunoglobulin lambda-like polypeptide 5 GN = IGLL5 |
| P01857 | Ig gamma-1 chain C region GN = IGHG1 |
| P01860 | Ig gamma-3 chain C region GN = IGHG3 |
| P01859 | Ig gamma-2 chain C region GN = IGHG2 |
| P01766 | Ig heavy chain V-III region BRO |
| O43866 | CD5 antigen-like GN = CD5L |
| P01877 | Ig alpha-2 chain C region GN = IGHA2 |
| P01617 | Ig kappa chain V-II region TEW |
| P01767 | Ig heavy chain V-III region BUT |
| P06310 | Ig kappa chain V-II region RPMI 6410 |
| P01768 | Ig heavy chain V-III region CAM |
| P01779 | Ig heavy chain V-III region TUR |
| P01620 | Ig kappa chain V-III region SIE |
| P01606 | Ig kappa chain V-I region OU |
| P04208 | Ig lambda chain V-I region WAH |
| P18135 | Ig kappa chain V-III region HAH |
| P01825 | Ig heavy chain V-II region NEWM |
| P01591 | Immunoglobulin J chain GN = IGJ |
| P01598 | Ig kappa chain V-I region EU |
| P01605 | Ig kappa chain V-I region Lay |
| P04433 | Ig kappa chain V-III region VG (Fragment) |
| P01610 | Ig kappa chain V-I region WEA |
| Q8WZ74 | Cortactin-binding protein 2 GN = CTTNBP2 |
| P01781 | Ig heavy chain V-III region GAL |
| P04003 | C4b-binding protein alpha chain GN = C4BPA |
| P00739 | Haptoglobin-related protein GN = HPR |
| P06312 | Ig kappa chain V-IV region (Fragment) GN = IGKV4-1 |
| P00738-2 | Isoform 2 of Haptoglobin GN = HP |
| P01625 | Ig kappa chain V-IV region Len |
| P01717 | Ig lambda chain V-IV region Hil |
| Q04695 | Keratin, type I cytoskeletal 17 GN = KRT17 |
| Q96PE2 | Rho guanine nucleotide exchange factor 17 GN = ARHGEF17 |
| P04211 | Ig lambda chain V region 4A |
| P05090 | Apolipoprotein D GN = APOD |
| P34096 | Ribonuclease 4 GN = RNASE4 |
| P01714 | Ig lambda chain V-III region SH |
| O14490-3 | Isoform 3 of Disks large-associated protein 1 GN = DLGAP1 |
| P04196 | Histidine-rich glycoprotein GN = HRG |
| P35030-5 | Isoform 5 of Trypsin-3 GN = PRSS3 |
| P04430 | Ig kappa chain V-I region BAN |
| P00748 | Coagulation factor XII GN = F12 |
| P06727 | Apolipoprotein A-IV GN = APOA4 |
| P02655 | Apolipoprotein C-II GN = APOC2 |
| P01611 | Ig kappa chain V-I region Wes |
| Q569G3 | Uncharacterized protein C5orf47 GN = C5orf47 |
| Q9Y490 | Talin-1 GN = TLN1 |
| Q5D862 | Filaggrin-2 GN = FLG2 |
| P01876 | Ig alpha-1 chain C region GN = IGHA1 |
| P01703 | Ig lambda chain V-I region NEWM |
| P02768 | Serum albumin GN = ALB |
| P10909-3 | Isoform 3 of Clusterin GN = CLU |
| P60709 | Actin, cytoplasmic 1 GN = ACTB |
| P04114 | Apolipoprotein B-100 GN = APOB |
| P0C0L4-2 | Isoform 2 of Complement C4-A GN = C4A |
| P0C0L5 | Complement C4-B GN = C4B |
| Q9H4B7 | Tubulin beta-1 chain GN = TUBB1 |
| P02675 | Fibrinogen beta chain GN = FGB |
| P01024 | Complement C3 GN = C3 |
| P35579 | Myosin-9 GN = MYH9 |
| P21333-2 | Isoform 2 of Filamin-A GN = FLNA |
| P02679-2 | Isoform Gamma-A of Fibrinogen gamma chain GN = FGG |
| P00698 | Lysozyme C OS = *Gallus gallus* GN = LYZ |
| P02671 | Fibrinogen alpha chain GN = FGA |
| P02647 | Apolipoprotein A-I GN = APOA1 |
| P68363-2 | Isoform 2 of Tubulin alpha-1B chain GN = TUBA1B |
| Q14624 | Inter-alpha-trypsin inhibitor heavy chain H4 GN = ITIH4 |
| P00747 | Plasminogen GN = PLG |
| P02649 | Apolipoprotein E GN = APOE |
| Q9Y2P0 | Zinc finger protein 835 GN = ZNF835 |
| Q96IY4 | Carboxypeptidase B2 GN = CPB2 |
| P08519 | Apolipoprotein(a) GN = LPA |
| P04264 | Keratin, type II cytoskeletal 1 GN = KRT1 |
| P35908 | Keratin, type II cytoskeletal 2 epidermal GN = KRT2 |
| P02751-10 | Isoform 10 of Fibronectin GN = FN1 |
| P01023 | Alpha-2-macroglobulin GN = A2M |
| P01009-2 | Isoform 2 of Alpha-1-antitrypsin GN = SERPINA1 |
| P05160 | Coagulation factor XIII B chain GN = F13B |
| P04004 | Vitronectin GN = VTN |
| Q86YZ3 | Hornerin GN = HRNR |
| P13645 | Keratin, type I cytoskeletal 10 GN = KRT10 |
| P13647 | Keratin, type II cytoskeletal 5 GN = KRT5 |
| Q03591 | Complement factor H-related protein 1 GN = CFHR1 |
| P08603 | Complement factor H GN = CFH |
| P35527 | Keratin, type I cytoskeletal 9 GN = KRT9 |
| P00488 | Coagulation factor XIII A chain GN = F13A1 |

The oligonucleotide sequences in Table 44 can be further modified to assess the effects of various subsequences and structural conformation on the ability to bind C1q. Exemplary rationally designed modifications are shown in Table 46. For example, the modifications can be based on the secondary structure of the oligonucleotides as estimated using mFold. The sequences in the table may comprise a modification such as a 5' Biotin motif. The Name column indicates the sequence and/or modifications thereof. For example, "83s B1 Full" (SEQ ID NO. 4328) consists of the 83s B1 sequence (SEQ ID NO. 1472) shown above with 5' and 3' regions (i.e., SEQ ID NOs. 131 and 132, respectively). Beneath are truncations ("TrXX-YY," where XX is the start position of the truncation and YY is the end position of the truncation as compared to the parent), substitutions (e.g., T(23)G indicating that T at position 23 of the parent sequence is modified to G), and combinations thereof "RC" indicates reverse complement sequence, in this case for use as a negative control. The italicized and underlined sequences highlight the 5'-ACAATCC consensus sequence.

TABLE 46

Modified anti-C1q oligonucleotide probe targets

| Name | Sequence | SEQ ID NO. |
|---|---|---|
| 83s B1 Full | CTAGCATGACTGCAGTACGTACTATAGA*ACAATCC*ACCGCTTTAAATCAACTATCTTACTGTCTCTTATACACATCTGACGCTGCCGACGA | 4328 |
| 83s B1_Tr17-62 | ACGTACTATAGAACAATCCACCGCTTTAAATCAACTATCTTACTGT | 4329 |
| 83s B1_Tr19-59 | GTACTATAGAACAATCCACCGCTTTAAATCAACTATCTTAC | 4330 |
| 83s B1_T(23)G | CTAGCATGACTGCAGTACGTACGATAGAACAATCCACCGCTTTAAATCAACTATCTTACTGTCTCTTATACACATCTGACGCTGCCGACGA | 4331 |
| 83s B1_Tr17-62T(23)G | ACGTACGATAGAACAATCCACCGCTTTAAATCAACTATCTTACTGT | 4332 |
| 83s B1_T(57)G | CTAGCATGACTGCAGTACGTACTATAGA*ACAATCC*ACCGCTTTAAATCAACTATCTGACTGTCTCTTATACACATCTGACGCTGCCGACGA | 4333 |
| 83s B1_T(57)G_Tr24-76 | ATAGA*ACAATCC*ACCGCTTTAAATCAACTATCTGACTGTCTCTTATACACATC | 4334 |
| 83S-B11 Full | CTAGCATGACTGCAGTACGTAACCCAATTCACATACACTCTCACCCCCACTAAACACTGTCTCTTATACACATCTGACGCTGCCGACGA | 4335 |
| B11_C(47)T | CTAGCATGACTGCAGTACGTAACC*CAATTCA*CATACACTCTCACCCTCACTAAACACTGTCTCTTATACACATCTGACGCTGCCGACGA | 4336 |
| B11_Tr19-35 | GTAACCCAATTCACATAC | 4337 |
| B11 Tr_G18_19-35_36C | GGTAACCCAATTCACATACC | 4338 |
| 83s B1RC (Negative Control) | CTAGCATGACTGCAGTACGTTAAGATAGTTGATTTAAAGCGGIGGATTGTTCTATAGTCTGTCTCTTATACACATCTGACGCTGCCGACGA | 4339 |
| 83S-B4 Full | CTAGCATGACTGCAGTACGTTACCCCTG*ACAATCC*TCGCGCCGAGGCCTCCATCCTGACTGTCTCTTATACACATCTGACGCTGCCGACGA | 4340 |
| 83s-B14 Full | CTAGCATGACTGCAGTACGTTACCCCTG*ACAATCC*TCGCGCCGAGGCCTCCATCCTCACTGTCTCTTATACACATCTGACGCTGCCGACGA | 4341 |
| 83s-B6 Full | CTAGCATGACTGCAGTACGTGATTTTAAAACCCTTGCACCTGATTGTGC*CAATCC*ACTGTCTCTTATACACATCTGACGCTGCCGACGA | 4342 |

In further analysis, C1q was immunoprecipitated from female plasma samples using the 83s B1 aptamer (or its negative control). For sequences, see Table 46 above. C1q was eluted with TFA/Urea+/−acetonitrile then detected by either an in-solution trypsin digestion followed by mass spectrometry or SDS-PAGE stained for total protein as in FIG. 24A (gel not shown). Mass Spectrometry was performed using the Q Exactive HF Mass Spectrometer system from ThermoFisher Scientific (Waltham, Mass.) according to the manufacturer's instructions. Various post-translational modifications (PTM) have been observed for C1q A. For example, the UniProt database lists various oxidation sites (e.g., P45, K48, P54, P57, P73, P79, P85) and galactosyl sites (e.g., K48, K67). Other modifications were reported in Pflieger et al., Analysis of Human C1q by Combined Bottom-up and Top-down Mass Spectrometry, Mol Cell Proteomics. 2010 April; 9(4): 593-610, which publication is incorporated by reference herein in its entirety. Table 47 lists PTMs observed in this study. The modifications in bold italics are previously unreported to our knowledge.

TABLE 47

Observed C1q A post-translational modifications

| Position | Target | Modification | Classification | Sequence Motif | SEQ ID NO. |
|---|---|---|---|---|---|
| 45 | P | Oxidation | Post-translational | PGRRGRpGLKGEQ | 4343 |
| 48 | K | Galactosyl | O-linked glycosylation | RGRPGLkGEQGEP | 4344 |
| 48 | K | Oxidation | Post-translational | RGRPGLkGEQGEP | 4345 |
| 54 | P | Oxidation | Post-translational | KGEQGEpGAPGIR | 4346 |

TABLE 47-continued

Observed C1q A post-translational modifications

| Position | Target | Modification | Classification | Sequence Motif | SEQ ID NO. |
|---|---|---|---|---|---|
| 57 | P | Oxidation | Post-translational | QGEPGApGIRTGI | 4346 |
| 67 | K | Galactosyl | O-linked glycosylation | TGIQGLkGDQGEP | 4347 |
| 73 | P | Oxidation | Post-translational | KGDQGEpGPSGNP | 4348 |
| 75 | P | Oxidation | Post-translational | DQGEPGpSGNPGK | 4349 |
| 79 | P | Oxidation | Post-translational | PGPSGNpGKVGYP | 4350 |
| 81 | K | Galactosyl | O-linked glycosylation | *PSGNPGkVGYPGP* | 4351 |
| 85 | P | Oxidation | Post-translational | PGKVGYpGPSGPL | 4352 |
| 87 | P | Oxidation | Post-translational | *KVGYPGpSGPLGA* | 4353 |
| 106 | P | Oxidation | Post-translational | *KGTKGSpGNIKDQ* | 4354 |
| 126 | M | Oxidation | Artefact | IRRNPPmGGNVVI | 4355 |
| 205 | M | Oxidation | Artefact | QVVSGGmVLQLQQ | 4356 |

Example 36: C1q Immunoassay and Isolation

This Example illustrates C1q immunoassays using an anti-C1q oligonucleotide. A nucleic acid construct is synthesized comprising an anti-C1q oligonucleotide region, for example, as described in Example 35 above. The anti-C1q construct comprises a 5' biotin modification to facilitate specific recognition by a desired moiety attached to streptavidin.

A labeled anti-C1q aptamer construct is constructed. The anti-C1q construct is contacted with fluorescently labeled streptavidin such as a streptavidin-Alexa Fluor® 488 conjugate from Thermo Fisher Scientific, Catalog number: S11223. This creates a fluorescently labeled anti-C1q construct which is used to detect C1q in various immunoassay formats. In one scenario, a biological sample known or suspected to contain C1q is contacted with an ELISA plate. The plate is washed and contacted with the fluorescently labeled anti-C1q construct. The fluorescent signal is read from the wells in the plate, thereby providing an indication of the presence or amount of C1q in the biological sample. In another scenario, a biological sample is directly contacted with the fluorescently labeled anti-C1q construct. The contacted sample is subjected to flow cytometry to detect fluorescent particles of the size of microvesicles, thereby providing an indication of the presence or amount of microvesicle associated C1q in the biological sample. Alternate labels such as disclosed herein or known in the art can be used in such formats.

Various modifications of the above scenarios are performed. For example, the anti-C1q aptamer is directly labeled with Alexa Fluor during the oligonucleotide synthesis process.

An immobilized anti-C1q aptamer is constructed. In one scenario, the anti-C1q aptamer construct is contacted with streptavidin conjugated beads. The beads are contacted with a biological sample known or suspected to contain C1q. The beads are precipitated (e.g., by centrifugation or magnetism) and washed. Proteins that precipitate with the beads are analyzed, thereby providing an indication of the presence or amount of C1q and associated proteins in the biological sample. In another scenario, the anti-C1q aptamer construct is contacted with streptavidin agarose resin, e.g., Pierce™ Streptavidin Agarose, Thermo Fisher Scientific Catalog number: 20347 or Pierce™ High Capacity Streptavidin Agarose Thermo Fisher Scientific Catalog number: 20357. The resins are placed in a spin column or chromatography column, respectively. The anti-C1q aptamer is contacted with the resin where it is bound by the streptavidin. A biological sample known or suspected to comprise C1q is allowed to pass through the resin. C1q and associated proteins in the biological sample are retained by the anti-C1q aptamer within the resin and are then analyzed after elution. In either scenario, if desired, the anti-C1q aptamer is contacted with the biological sample in solution and then the sample is contacted with the beads or resin. C1q and associated proteins are analyzed as above. This modification allows the C1q and aptamer to bind freely in solution prior to aptamer immobilization.

Various modifications of the above scenarios are performed. For example, the anti-C1q aptamer is directly conjugated to a bead or other desired surface.

One of skill will appreciate that the anti-C1q aptamer construct can be used in any desired scenario where antibodies are conventionally used. See, e.g., Toh et al., Aptamers as a replacement for antibodies in enzyme-linked immunosorbent assay. Biosens Bioelectron. 2015 Feb. 15; 64:392-403. doi: 10.1016/j.bios.2014.09.026. Epub 2014 Sep. 16; Chen and Yang, Replacing antibodies with aptamers in lateral flow immunoassay. Biosens Bioelectron. 2015 Sep. 15; 71:230-42. doi: 10.1016/j.bios.2015.04.041. Epub 2015 Apr. 14; Guthrie et al, Assays for cytokines using aptamers. Methods. 2006 April; 38(4):324-30; Romig et al., Aptamer affinity chromatography: combinatorial chemistry applied to protein purification. J Chromatogr B Biomed Sci Appl. 1999 Aug. 20; 731(2):275-84.

Example 37: C1q Detection in Bodily Fluids

This Example describes using an anti-C1q oligonucleotide to detect C1q in bodily fluids. A bodily fluid such as blood or a derivative thereof, including without limitation sera or plasma, is obtained from a subject. An assay such as described in Example 36 is used to detect C1q in the bodily fluid. As desired, such detection may assist in the diagnosis, prognosis or theranosis of a disease or disorder. See, e.g., Examples 13-14 herein.

In one scenario, the anti-C1q aptamer is used to capture and quantitate immune complexes in clinical samples based on the ability of C1q to preferentially bind immune complexes versus monomeric immunoglobulins.

Example 38: C1q Inhibition

This Example describes using an anti-C1q oligonucleotide to inhibit C1q mediated apoptosis.

Deficiency in the host C1q inhibitor protein, encoded by the SERPING1 gene (also known as C1NH and others), is associated with hereditary angioedema ("hereditary angioneurotic edema"; "HAE"), which comprises swelling due to leakage of fluid from blood vessels into connective tissue. In addition to facial swelling and/or abdominal pain, C1q inhibitor deficiency also predisposes to autoimmune diseases, e.g., lupus erythematosus, and age related macular degeneration. C1q inhibitors CINRYZE® (C1 esterase inhibitor [human]) and RUCONEST® (C1 esterase inhibitor [recombinant]) are approved by the US FDA for HAE symptoms. See, e.g., Bernstein, Hereditary angioedema: a current state-of-the-art review, VIII: current status of emerging therapies. Ann. Allergy Asthma Immunol. 100 (1 Suppl 2): S41-6 (January 2008). A pharmaceutical composition comprising an anti-C1q oligonucleotide of the invention is administered to an HAE patient in sufficient dosage to ameliorate symptoms of HAE.

As the complement cascade damages cells, C1q inhibitors have potential functionality for diseases other than HAE. See e.g., Caliezi et al, C1-Esterase inhibitor: an anti-inflammatory agent and its potential use in the treatment of diseases other than hereditary angioedema. Pharmacol. Rev. 52 (1): 91-112 (March 2000). During heart attack, lack of oxygen in heart cells causes necrosis in heart cells. Dying heart cells spill their contents in the extracellular environment, which triggers the complement cascade and may increase the damage for the surviving heart cells. A pharmaceutical composition comprising an anti-C1q oligonucleotide of the invention is administered to a heart attack victim in sufficient dosage to ameliorate complement-mediated heart damage. Similarly, a pharmaceutical composition comprising an anti-C1q oligonucleotide of the invention is administered to a patient following organ transplantation to ameliorate delayed graft function.

The complement cascade is a first defense against non-self cells and is also activated by malignant cells. Thus, complement appears to play a role in cancer surveillance by the immune system. Recently, however, it has been reported that the complement system can also play a role in promoting tumor growth, inflammation and angiogenesis. Thus, complement inhibition has been proposed for cancer treatment. See, e.g., Pio et al, Complement inhibition: a promising concept for cancer treatment, Semin Immunol. 2013 February; 25(1): 54-64; Pio et al., The role of complement in tumor growth. Adv Exp Med Biol. 2014; 772:229-62. It has further been reported that C1q may act in the tumor microenvironment to promote cancer independently of its complement function. Bulla et al. report that C1q may promote cancer cell adhesion, migration and proliferation as well as angiogenesis and metastasis. See Bulla et al., C1q acts in the tumour microenvironment as a cancer-promoting factor independently of complement activation. Nat Commun. 2016; 7: 10346. A pharmaceutical composition comprising an anti-C1q oligonucleotide of the invention is administered to a cancer victim in sufficient dosage to treat the cancer in the victim. As desired, the composition is administered in combination with traditional cancer therapeutics or in addition to immune therapies, e.g., cell-based tumor immunotherapies, or antitumor vaccines.

Example 39: Complement Cascade Initiation

This Example describes using an anti-C1q oligonucleotide to direct complement mediated cell killing.

Antibody immunotherapies may direct the killing of target cells through several mechanisms, including without limitation complement-dependent cytotoxicity (CDC), antibody-dependent cellular cytotoxicity (ADCC), apoptosis, and direct growth arrest. See, e.g., Taylor and Lindorfer, The role of complement in mAb-based therapies of cancer. Methods. 2014 Jan. 1; 65(1):18-27. doi: 10.1016/j.ymeth.2013.07.027. Epub 2013 Jul. 22; Rogers et al., Complement in monoclonal antibody therapy of cancer. Immunol Res. 2014 August; 59(1-3):203-10. doi: 10.1007/s12026-014-8542-z; Zhou et al., The Role of Complement in the Mechanism of Action of Rituximab for B-Cell Lymphoma: Implications for Therapy, The Oncologist September 2008 vol. 13 no. 9 954-966; Di Gaetano et al., Complement activation determines the therapeutic activity of rituximab in vivo. J Immunol. 2003 Aug. 1; 171(3):1581-7.

The Fc regions of membrane-bound therapeutic antibodies interact with the heterooligomeric C1q complex and activate the classical complement pathway to initiate CDC. A multipartite construct comprising an anti-C1q oligonucleotide of the invention is provided in a pharmaceutical composition. The pharmaceutical composition is administered to a cancer victim in sufficient dosage to treat the cancer in the victim. The construct comprises the anti-C1q oligonucleotide connected to an anti-tumor domain. See, e.g., FIGS. 23A-D herein and related discussion. The anti-tumor domain can be to a general tumor antigen or specific to a tumor of a given origin. See, e.g., Section "Anti-target and multivalent oligonucleotides" herein for illustrative targets. As desired, the multipartite construct comprising an anti-C1q oligonucleotide is used to direct complement mediated cell killing where cancer cells and tumors have adapted to evade the complement system.

As noted herein, C1q may play a role in both preventing cancer, e.g., through complement mediated cell killing, and facilitating the growth of cancer, e.g., through cancer cell adhesion, migration and proliferation as well as angiogenesis and metastasis, perhaps in a non-complement fashion. Such disparate roles allow for combination treatment with oligonucleotides of the invention that both inhibit the roles of C1q in promoting cancer while targeting C1q mediated cell killing to cancer cells. A multipartite construct comprising an anti-C1q oligonucleotide of the invention is provided in a pharmaceutical composition. An anti-C1q oligonucleotide of the invention that inhibits non-complement functions of C1q is provided in a pharmaceutical composition. The pharmaceutical compositions are administered to a cancer victim in sufficient dosage to treat the cancer in the victim.

Although preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (4356 sequences)

SEQ ID NO: 1 - DNA, 32 bp, Artificial Sequence
  Synthetic oligonucleotide
ccccccgaatcacatgacttgggcgggggtcg

SEQ ID NO: 2 - DNA, 32 bp, Artificial Sequence
  Synthetic oligonucleotide
accggatagcggttggaggcgtgctccactcg

SEQ ID NO: 3 - DNA, 32 bp, Artificial Sequence
  Synthetic oligonucleotide
ccgcgcagatatacaacgtacctctgtgcgca

SEQ ID NO: 4 - DNA, 70 bp, Artificial Sequence
  Synthetic oligonucleotide
atccagagtgacgcagcagtcttttctgatggacacgtggtggtctagtatctggacacggtggcttagt

SEQ ID NO: 5 - RNA, 70 nt, Artificial Sequence
  Synthetic oligonucleotide
auccagagugacgcagcagucuuuucugauggacacgugguggucuaguaucacuaagccaccgugucca

SEQ ID NO: 6 - DNA, 32 bp, Artificial Sequence
  Synthetic oligonucleotide
ctgtgaggcgtactgcggtgagcctctcatta

SEQ ID NO: 7 - DNA, 26 bp, Artificial Sequence
  Synthetic oligonucleotide
caattgggcccgtccgtatggtgggt

SEQ ID NO: 8 - RNA, 80 nt, Artificial Sequence
  Synthetic oligonucleotide
  misc_feature (16)..(55): n is a, c, g, or u
gggaggacgaugcggnnnnnnnnnnnnnnnnnnnnnnnnnnnnnnnnnnnnnnnncagacgacucgcugaggauccgaga

SEQ ID NO: 9 - RNA, 15 nt, Artificial Sequence
  Synthetic oligonucleotide
gggaggacgaugcgg

SEQ ID NO: 10 - RNA, 25 nt, Artificial Sequence
  Synthetic oligonucleotide
cagacgacucgcugaggauccgaga

SEQ ID NO: 11 - RNA, 40 nt, Artificial Sequence
  Synthetic oligonucleotide
cgcgucuuccccgcauugccgcaauugccauacauuaaua

SEQ ID NO: 12 - DNA, 40 bp, Artificial Sequence
  Synthetic oligonucleotide
cgcgtcttccccgcattgccgcaattgccatacattaata

SEQ ID NO: 13 - RNA, 40 nt, Artificial Sequence
  Synthetic oligonucleotide
guccggaacgccucgauccucgcauaauaugauacgucug

SEQ ID NO: 14 - DNA, 40 bp, Artificial Sequence
  Synthetic oligonucleotide
gtccggaacgcctcgatcctcgcataatatgatacgtctg

SEQ ID NO: 15 - RNA, 40 nt, Artificial Sequence
  Synthetic oligonucleotide
guccaugguacgccucgauuccgcccauacaugcauguaa

SEQ ID NO: 16 - DNA, 40 bp, Artificial Sequence
  Synthetic oligonucleotide
gtccatggtacgcctcgattccgcccatacatgcatgtaa

SEQ ID NO: 17 - RNA, 40 nt, Artificial Sequence
  Synthetic oligonucleotide
cacuauccguuuguccguccucuugugguauugcgcaugc

SEQ ID NO: 18 - DNA, 40 bp, Artificial Sequence
  Synthetic oligonucleotide
cactatccgtttgtccgtcctcttgtggtattgcgcatgc

SEQ ID NO: 19 - RNA, 40 nt, Artificial Sequence
  Synthetic oligonucleotide
ucuuccaucuggucgcgauacagaauacgauuaacauaaa

SEQ ID NO: 20 - DNA, 40 bp, Artificial Sequence
  Synthetic oligonucleotide
tcttccatctggtcgcgatacagaatacgattaacataaa

SEQ ID NO: 21 - RNA, 40 nt, Artificial Sequence
  Synthetic oligonucleotide
gaucacgcugcccuuuguuuaaggccuuuauacaaacgca

SEQ ID NO: 22 - DNA, 40 bp, Artificial Sequence
  Synthetic oligonucleotide
gatcacgctgccctttgtttaaggcctttatacaaacgca

SEQ ID NO: 23 - RNA, 40 nt, Artificial Sequence
  Synthetic oligonucleotide
uauucgccagucacaucaacuaugaugacgcuugacugga

SEQ ID NO: 24 - DNA, 40 bp, Artificial Sequence
  Synthetic oligonucleotide
tattcgccagtcacatcaactatgatgacgcttgactgga

SEQ ID NO: 25 - RNA, 40 nt, Artificial Sequence
  Synthetic oligonucleotide
uaccgccucaucaucggacacgacguguaucaguuggcug

SEQ ID NO: 26 - RNA, 40 nt, Artificial Sequence
  Synthetic oligonucleotide
guucucgccucuguccucaugguucgaaccgguaugcaug

SEQ ID NO: 27 - RNA, 40 nt, Artificial Sequence
  Synthetic oligonucleotide
gcgguuucuucuccugacuacaugagauuaauaaacgcgc

SEQ ID NO: 28 - RNA, 40 nt, Artificial Sequence
  Synthetic oligonucleotide
ccgccucgaacacugacgucguggaaccuucgauugcuag

SEQ ID NO: 29 - RNA, 40 nt, Artificial Sequence
  Synthetic oligonucleotide
aaucacaguaauucugccccucugaugaaaccgguuacuu

SEQ ID NO: 30 - RNA, 40 nt, Artificial Sequence
  Synthetic oligonucleotide
cuuagugauuucgccgccccucuguuuaguggccauugga

SEQ ID NO: 31 - RNA, 40 nt, Artificial Sequence
  Synthetic oligonucleotide
acacuauuccgguaagucaucguuuaaccguuuguugcaa

SEQ ID NO: 32 - RNA, 40 nt, Artificial Sequence
  Synthetic oligonucleotide
ugcgcaacgccuugauucacuccuacagugugucuauaga

SEQ ID NO: 33 - RNA, 40 nt, Artificial Sequence
  Synthetic oligonucleotide
aauguuaagcuuacauacgccugggucacucuuuguucug

SEQ ID NO: 34 - RNA, 40 nt, Artificial Sequence
  Synthetic oligonucleotide
guaaauauucacguugaaucgccuugcuccucuuagucug

SEQ ID NO: 35 - RNA, 40 nt, Artificial Sequence
  Synthetic oligonucleotide
ccgccucggaucguucccaauggugguaccccuauuaaug

SEQ ID NO: 36 - RNA, 40 nt, Artificial Sequence
  Synthetic oligonucleotide
uguagaucguucuuauccgccucggucuuccccagguuaa

SEQ ID NO: 37 - RNA, 40 nt, Artificial Sequence
  Synthetic oligonucleotide
aucgucgggccccuuuuaugaaacuuacaugaaagcgcac

SEQ ID NO: 38 - RNA, 40 nt, Artificial Sequence
  Synthetic oligonucleotide
uaagagugcacaguacugccucgauccuccauggcuuaag

SEQ ID NO: 39 - RNA, 40 nt, Artificial Sequence
  Synthetic oligonucleotide
gaauuaguacugacggccgccuugauccuccguuagucug

SEQ ID NO: 40 - RNA, 40 nt, Artificial Sequence
  Synthetic oligonucleotide
gcccgccuccgaagcccuccuaagugcacuuuaaaccgcg

SEQ ID NO: 41 - RNA, 40 nt, Artificial Sequence
  Synthetic oligonucleotide
ccgccugggaucacucucuacgcguauaaaugcucuguca

SEQ ID NO: 42 - RNA, 40 nt, Artificial Sequence
  Synthetic oligonucleotide
agucugacccuguuauggacuaccauaucagaaagguacu

SEQ ID NO: 43 - RNA, 40 nt, Artificial Sequence
  Synthetic oligonucleotide
ggugauccucccccccgccucgaagauuugugcacauauc

SEQ ID NO: 44 - RNA, 40 nt, Artificial Sequence
  Synthetic oligonucleotide
gcuaccaucgucuagugagucacccuuaguucaucaaggc

SEQ ID NO: 45 - DNA, 18 bp, Artificial Sequence
  Synthetic oligonucleotide
gctgtgtgactcctgcaa

SEQ ID NO: 46 - DNA, 19 bp, Artificial Sequence
  Synthetic oligonucleotide
gcagctgtatcttgtctcc

SEQ ID NO: 47 - DNA, 43 bp, Artificial Sequence
  Synthetic oligonucleotide
gtccgcttgggggtgggtatcgaaaattcgcgttctggggcgg

SEQ ID NO: 48 - DNA, 43 bp, Artificial Sequence
  Synthetic oligonucleotide
cttcgctcgtttcaatgttcagttctggtctttaggtctttag

SEQ ID NO: 49 - DNA, 43 bp, Artificial Sequence
  Synthetic oligonucleotide
taggaggataatatgtatccggtgcatcggcctgactttcccc

SEQ ID NO: 50 - DNA, 43 bp, Artificial Sequence
  Synthetic oligonucleotide
taggagggctgaaaacttgcttcttcccggtgcagttataaca

SEQ ID NO: 51 - DNA, 43 bp, Artificial Sequence
  Synthetic oligonucleotide
taggaggataatatgtatccgatgcatgggcccgactttcccc

SEQ ID NO: 52 - DNA, 43 bp, Artificial Sequence
  Synthetic oligonucleotide
tgcgttttccttggggttcagggtaggatgggggtggaggtgg

SEQ ID NO: 53 - DNA, 43 bp, Artificial Sequence
  Synthetic oligonucleotide
ggggggcgggtgggctggtaaaaggtgatgcgggggtattgtt

SEQ ID NO: 54 - DNA, 43 bp, Artificial Sequence
  Synthetic oligonucleotide
taggaggataatatgtatccggtgcatcggcccaactttcccc

SEQ ID NO: 55 - DNA, 43 bp, Artificial Sequence
  Synthetic oligonucleotide
ccaatctcggaaggtttaaataaggtggtctttaggtctttag

SEQ ID NO: 56 - DNA, 43 bp, Artificial Sequence
  Synthetic oligonucleotide
tacgttaagtgggtcgggaggggggaatagggggtttggttgg

SEQ ID NO: 57 - DNA, 43 bp, Artificial Sequence
  Synthetic oligonucleotide
gtgaggtcggtggggcgggggatggtggggggtcgtttacatt

SEQ ID NO: 58 - DNA, 42 bp, Artificial Sequence
  Synthetic oligonucleotide
cgatattgggggggggttggcgggctattttccgggtgggtg

SEQ ID NO: 59 - DNA, 43 bp, Artificial Sequence
  Synthetic oligonucleotide
tcggttcctgttaattcgctggtggttggtggggtggcggatg

SEQ ID NO: 60 - DNA, 42 bp, Artificial Sequence
  Synthetic oligonucleotide
gcggggaggtgggggtgggtggagggttggttactctctact

SEQ ID NO: 61 - DNA, 43 bp, Artificial Sequence
  Synthetic oligonucleotide
cgggaatgggagggtgggggtggtggccgggtcgtgttatacc

SEQ ID NO: 62 - DNA, 43 bp, Artificial Sequence
  Synthetic oligonucleotide
taggaggataatatgtatccggtgcatcggtccgactttcccc

SEQ ID NO: 63 - DNA, 43 bp, Artificial Sequence
  Synthetic oligonucleotide
tatagttgggcgtaggcgggggggggtggttgggaggtccaag

SEQ ID NO: 64 - DNA, 43 bp, Artificial Sequence
  Synthetic oligonucleotide
taggaggataatatgtatccggtgcatcggcccgaccttcccc

SEQ ID NO: 65 - DNA, 43 bp, Artificial Sequence
  Synthetic oligonucleotide
tcgatcgtcctcaggatctcgtggttcaaatcataaagattat

SEQ ID NO: 66 - DNA, 43 bp, Artificial Sequence
  Synthetic oligonucleotide
tgctgtctgggcgggggcggtcttgtggtttctttgggggggg

SEQ ID NO: 67 - DNA, 43 bp, Artificial Sequence
  Synthetic oligonucleotide
gcgagacaggagggtggtcttatacgtgggggggggtggttgg

SEQ ID NO: 68 - DNA, 43 bp, Artificial Sequence
  Synthetic oligonucleotide
taggagggctgaagacttgcttcttcccggtgcagttataaca

SEQ ID NO: 69 - DNA, 43 bp, Artificial Sequence
  Synthetic oligonucleotide
cgtgtggggggtgggttgggctcgggttgttatcagttccatg

SEQ ID NO: 70 - DNA, 43 bp, Artificial Sequence
  Synthetic oligonucleotide
cgatattggggggggggttggcgggctattttccgggtgggtg

SEQ ID NO: 71 - DNA, 43 bp, Artificial Sequence
  Synthetic oligonucleotide
taggaggataatatgtatccggtgcatcggcccgactttcctc

SEQ ID NO: 72 - DNA, 43 bp, Artificial Sequence
  Synthetic oligonucleotide
taggaggataatatgtatccggtgcatcggctcgactttcccc

SEQ ID NO: 73 - DNA, 43 bp, Artificial Sequence
  Synthetic oligonucleotide
cttcgctcgtttcaatgtttagttctggtctttaggtctttag

SEQ ID NO: 74 - DNA, 43 bp, Artificial Sequence
  Synthetic oligonucleotide
ggacatgggttgggtcgggagggggtggtcggttgggcagtaa

SEQ ID NO: 75 - DNA, 43 bp, Artificial Sequence
  Synthetic oligonucleotide
taggaggataatatgtatacgatgcatcggcccgactttcccc

SEQ ID NO: 76 - DNA, 43 bp, Artificial Sequence
  Synthetic oligonucleotide
taggaggataatatgtatcagatgcatcggcccgactttcccc

SEQ ID NO: 77 - DNA, 43 bp, Artificial Sequence
  Synthetic oligonucleotide
tggatgtatggggtctcggggtgggagggttcaacttatctgg

SEQ ID NO: 78 - DNA, 43 bp, Artificial Sequence; identical to SEQ ID NO: 47
  Synthetic oligonucleotide

SEQ ID NO: 79 - DNA, 43 bp, Artificial Sequence
  Synthetic oligonucleotide
tcttgtacaaataggagggaagggggttttgggaggtgggtgg

SEQ ID NO: 80 - DNA, 43 bp, Artificial Sequence; identical to SEQ ID NO: 48
  Synthetic oligonucleotide

SEQ ID NO: 81 - DNA, 43 bp, Artificial Sequence
  Synthetic oligonucleotide
ctgatgttagtaggtcggggtccggttgggggttgggttgagg

SEQ ID NO: 82 - DNA, 43 bp, Artificial Sequence
  Synthetic oligonucleotide
tggctcgtggacgtggtggtggcgggtcgtgggggtgggtagg

SEQ ID NO: 83 - DNA, 43 bp, Artificial Sequence
  Synthetic oligonucleotide
taggaggataatatgtatccgatgcatcggcacgactttcccc

SEQ ID NO: 84 - DNA, 43 bp, Artificial Sequence
  Synthetic oligonucleotide
cggggagggggggtcggggtatttattgtgtatgttttttgtg

SEQ ID NO: 85 - DNA, 43 bp, Artificial Sequence
  Synthetic oligonucleotide
tgactgtatcttggggcgggttctggggggggtgtattgttca

SEQ ID NO: 86 - DNA, 43 bp, Artificial Sequence
  Synthetic oligonucleotide
taggaggataatatgtatccgatgcatcggcccgactttcacc

SEQ ID NO: 87 - DNA, 43 bp, Artificial Sequence
  Synthetic oligonucleotide
tcatgtctaggggggggaagtcggtttgggtgggtactctgtg

SEQ ID NO: 88 - DNA, 43 bp, Artificial Sequence
  Synthetic oligonucleotide
cttgtttcgctttgggtttgggcgggtgggtcaattcctgttg

SEQ ID NO: 89 - DNA, 43 bp, Artificial Sequence
  Synthetic oligonucleotide
ggtgggggccctcggtactgtggcggggtgggtgggtttagtg

SEQ ID NO: 90 - DNA, 43 bp, Artificial Sequence; identical to SEQ ID NO: 52
  Synthetic oligonucleotide

SEQ ID NO: 91 - DNA, 43 bp, Artificial Sequence
  Synthetic oligonucleotide
tggtggggtgggtctgtggggtggttttgttcttatcggggtt

SEQ ID NO: 92 - DNA, 43 bp, Artificial Sequence
  Synthetic oligonucleotide
tgggtgggttacgggtgggtgttgttatcgcgctgatctggtt

SEQ ID NO: 93 - DNA, 43 bp, Artificial Sequence
  Synthetic oligonucleotide
cgtgacggttttaatcaggggggggactctaacatttgggtgg

SEQ ID NO: 94 - DNA, 43 bp, Artificial Sequence
  Synthetic oligonucleotide
tgctcatatcgtggggggatggggttgctagtggatggggtgg

SEQ ID NO: 95 - DNA, 43 bp, Artificial Sequence; identical to SEQ ID NO: 53
  Synthetic oligonucleotide

SEQ ID NO: 96 - DNA, 43 bp, Artificial Sequence
  Synthetic oligonucleotide
tgatgtggggggtggggtataatacttatgtttggggtttggg

SEQ ID NO: 97 - DNA, 43 bp, Artificial Sequence
  Synthetic oligonucleotide
ttgggtgggtgggaatgggtattttttcttcgggcgatgtttg

SEQ ID NO: 98 - DNA, 43 bp, Artificial Sequence
  Synthetic oligonucleotide
tagttggatactggatttgggagggatggggggaggagggtgg

SEQ ID NO: 99 - DNA, 42 bp, Artificial Sequence
  Synthetic oligonucleotide
ctggaaggttgggtgtggggcgggggggaggtctctctatgt

SEQ ID NO: 100 - DNA, 43 bp, Artificial Sequence; identical to SEQ ID NO: 56
  Synthetic oligonucleotide

SEQ ID NO: 101 - DNA, 43 bp, Artificial Sequence
  Synthetic oligonucleotide
tgccgtgggccggggagggtgggttggcgtctctgtttcgata

SEQ ID NO: 102 - DNA, 43 bp, Artificial Sequence
  Synthetic oligonucleotide
gggggggcggccggggtggactgtggcccgtcttcgtattgtt

SEQ ID NO: 103 - DNA, 42 bp, Artificial Sequence
  Synthetic oligonucleotide
tggtggtggctgggggacgggtatcctggaattaggggtggg

SEQ ID NO: 104 - DNA, 43 bp, Artificial Sequence
  Synthetic oligonucleotide
tcggttcatgttgggtgggatcggggcggggtttcttctcctg

SEQ ID NO: 105 - DNA, 43 bp, Artificial Sequence; identical to SEQ ID NO: 75
  Synthetic oligonucleotide

SEQ ID NO: 106 - DNA, 43 bp, Artificial Sequence
  Synthetic oligonucleotide
tcgtgggtgtgttctggggggcgtggacgggggttaatgggca

SEQ ID NO: 107 - DNA, 43 bp, Artificial Sequence
  Synthetic oligonucleotide
taggaggataatatgtatccgatgcatcggcccgactttcccc

SEQ ID NO: 108 - DNA, 43 bp, Artificial Sequence
  Synthetic oligonucleotide
taagagtcttaggatgacgtcattcgtccgtcacggtgcggga

SEQ ID NO: 109 - DNA, 43 bp, Artificial Sequence
  Synthetic oligonucleotide
gcctggccagatagcagttaccttacgggatctatattcaccg

SEQ ID NO: 110 - DNA, 43 bp, Artificial Sequence; identical to SEQ ID NO: 82
  Synthetic oligonucleotide

SEQ ID NO: 111 - DNA, 43 bp, Artificial Sequence
  Synthetic oligonucleotide
ttcgtgttcatctgtttattgttattcacaatccgtcttttgt

SEQ ID NO: 112 - DNA, 43 bp, Artificial Sequence
  Synthetic oligonucleotide
cgaatccgtcgaccgccctcgtaaccatccaacccagtctcct

SEQ ID NO: 113 - DNA, 43 bp, Artificial Sequence
  Synthetic oligonucleotide
caggaaagttacttatcttttagacggttatgttctcattact

SEQ ID NO: 114 - DNA, 43 bp, Artificial Sequence
  Synthetic oligonucleotide
atctgctcgatacgtagatagtctgctcgatacaaaagggtgg

SEQ ID NO: 115 - DNA, 43 bp, Artificial Sequence
  Synthetic oligonucleotide
cgatgagcgggctccgatattgtgtcggcgtgactaccttgat

SEQ ID NO: 116 - DNA, 43 bp, Artificial Sequence
  Synthetic oligonucleotide
ggtcggcctatttattgcggcacgttgtttcttgatgtcgccc

SEQ ID NO: 117 - DNA, 43 bp, Artificial Sequence
  Synthetic oligonucleotide
tcgaattcagttctacatgtgtatttcttgctccgtttcagaa

SEQ ID NO: 118 - DNA, 43 bp, Artificial Sequence
  Synthetic oligonucleotide
tcggtccggcaacaaaccccacgcgccttcgatatgcctgtcg

SEQ ID NO: 119 - DNA, 43 bp, Artificial Sequence; identical to SEQ ID NO: 55
  Synthetic oligonucleotide

SEQ ID NO: 120 - DNA, 43 bp, Artificial Sequence; identical to SEQ ID NO: 70
  Synthetic oligonucleotide

SEQ ID NO: 121 - DNA, 43 bp, Artificial Sequence; identical to SEQ ID NO: 61
  Synthetic oligonucleotide

SEQ ID NO: 122 - DNA, 43 bp, Artificial Sequence
  Synthetic oligonucleotide
cgtggtgggttcttgggtggggggggagggttggcgtagtata

SEQ ID NO: 123 - DNA, 43 bp, Artificial Sequence; identical to SEQ ID NO: 57
  Synthetic oligonucleotide

SEQ ID NO: 124 - DNA, 43 bp, Artificial Sequence; identical to SEQ ID NO: 56
  Synthetic oligonucleotide

SEQ ID NO: 125 - DNA, 43 bp, Artificial Sequence; identical to SEQ ID NO: 54
  Synthetic oligonucleotide

SEQ ID NO: 126 - DNA, 43 bp, Artificial Sequence; identical to SEQ ID NO: 50
  Synthetic oligonucleotide

SEQ ID NO: 127 - DNA, 43 bp, Artificial Sequence; identical to SEQ ID NO: 59
  Synthetic oligonucleotide

SEQ ID NO: 128 - DNA, 43 bp, Artificial Sequence; identical to SEQ ID NO: 66
  Synthetic oligonucleotide

SEQ ID NO: 129 - DNA, 43 bp, Artificial Sequence
  Synthetic oligonucleotide
aacatggggttctgataaacctgtgccaaatacattgttgagt

SEQ ID NO: 130 - DNA, 43 bp, Artificial Sequence
  Synthetic oligonucleotide
attcctcctttgtaagggatgatatccaactcctctgcgttcg

SEQ ID NO: 131 - DNA, 20 bp, Artificial Sequence
  Synthetic oligonucleotide
ctagcatgactgcagtacgt

SEQ ID NO: 132 - DNA, 33 bp, Artificial Sequence
  Synthetic oligonucleotide
ctgtctcttatacacatctgacgctgccgacga

SEQ ID NO: 133 - DNA, 15 bp, Artificial Sequence
  Synthetic oligonucleotide
tcgtcggcagcgtca

SEQ ID NO: 134 - protein, 8 aa, Artificial Sequence
  Synthetic peptide
DYKDDDDK

SEQ ID NO: 135 - protein, 9 aa, Artificial Sequence
  Synthetic peptide
YPYDVPDYA

SEQ ID NO: 136 - protein, 10 aa, Artificial Sequence
  Synthetic peptide
EQKLISEEDL

SEQ ID NO: 137 - DNA, 35 bp, Artificial Sequence
  Synthetic oligonucleotide
aacccgcgtgattggggtactgcccatgcgacttt

SEQ ID NO: 138 - DNA, 35 bp, Artificial Sequence
  Synthetic oligonucleotide
aactgaaggccaattaaactccactgtgctaatct

SEQ ID NO: 139 - DNA, 38 bp, Artificial Sequence
  Synthetic oligonucleotide
acatgccggcgttgatactctactgtgctccattatga

SEQ ID NO: 140 - DNA, 36 bp, Artificial Sequence
  Synthetic oligonucleotide
agacatgccacgccctttacatactccactgtgcca

SEQ ID NO: 141 - DNA, 34 bp, Artificial Sequence
  Synthetic oligonucleotide
agccacgcagacctatctctactgtgccaatgtt

SEQ ID NO: 142 - DNA, 37 bp, Artificial Sequence
  Synthetic oligonucleotide
aggtacgtaaggctgccattactctctactgtgccga

SEQ ID NO: 143 - DNA, 35 bp, Artificial Sequence
  Synthetic oligonucleotide
agtctagcgatcgacttttctctacggtgcccttc

SEQ ID NO: 144 - DNA, 37 bp, Artificial Sequence
  Synthetic oligonucleotide
agtgtgcgcatgaatccattactccactgtgccttga

SEQ ID NO: 145 - DNA, 37 bp, Artificial Sequence
  Synthetic oligonucleotide
agttgcagacccttgtattctctaccgtgccctatga

SEQ ID NO: 146 - DNA, 34 bp, Artificial Sequence
  Synthetic oligonucleotide
cactgctaactgatattgttgaactccaccgtgc

SEQ ID NO: 147 - DNA, 38 bp, Artificial Sequence
  Synthetic oligonucleotide
catgcgacaagcttccattaaccatccgctatttatga

SEQ ID NO: 148 - DNA, 36 bp, Artificial Sequence
  Synthetic oligonucleotide
catgcggaccacgctttcacaaactcatgattcaaa

SEQ ID NO: 149 - DNA, 35 bp, Artificial Sequence
  Synthetic oligonucleotide
catgcgtacgtcctattctctctactgtgcattaa

SEQ ID NO: 150 - DNA, 35 bp, Artificial Sequence
  Synthetic oligonucleotide
cctgcaatgcggaaacccttctactctactgtgcc

SEQ ID NO: 151 - DNA, 36 bp, Artificial Sequence
  Synthetic oligonucleotide
cgcgagccagggtactgcctgcggtctaaacaatca

SEQ ID NO: 152 - DNA, 36 bp, Artificial Sequence
  Synthetic oligonucleotide
cgtgcgacttgttctctactgtgccaataaaccata

SEQ ID NO: 153 - DNA, 35 bp, Artificial Sequence
  Synthetic oligonucleotide
gatagcgcatattcctctactgtgctacttgttat

SEQ ID NO: 154 - DNA, 36 bp, Artificial Sequence
  Synthetic oligonucleotide
gcaaaccaattagtgtacctctaccgtgcccaatga

SEQ ID NO: 155 - DNA, 38 bp, Artificial Sequence
  Synthetic oligonucleotide
gcaactactctctaccgtgcccagtgatttctccatga

SEQ ID NO: 156 - DNA, 36 bp, Artificial Sequence
  Synthetic oligonucleotide
gcaccacatgtcaatctctactgtgcttatctcata

SEQ ID NO: 157 - DNA, 36 bp, Artificial Sequence
  Synthetic oligonucleotide
gcagcacaaaagttactctcctctaccgtgccccta

SEQ ID NO: 158 - DNA, 36 bp, Artificial Sequence
  Synthetic oligonucleotide
gcagtttgcgtggatactctactgtgctgaccctta

SEQ ID NO: 159 - DNA, 36 bp, Artificial Sequence
  Synthetic oligonucleotide
gcatacatgaactctaccgtgcccgttgacttgaaa

SEQ ID NO: 160 - DNA, 35 bp, Artificial Sequence
  Synthetic oligonucleotide
gcatagcggttcacattattttactctaccgtgcc

SEQ ID NO: 161 - DNA, 34 bp, Artificial Sequence
  Synthetic oligonucleotide
gccacagtatcgttctcgagctggttcccgccat

SEQ ID NO: 162 - DNA, 38 bp, Artificial Sequence
  Synthetic oligonucleotide
gcgaacatcactctaccgtgccatctgaaatgacgtga

SEQ ID NO: 163 - DNA, 38 bp, Artificial Sequence
  Synthetic oligonucleotide
gcgaacttgtaactctactgtgcttatattaaggttga

SEQ ID NO: 164 - DNA, 35 bp, Artificial Sequence
  Synthetic oligonucleotide
gcgaccaatactctactgtgctgatacggatttta

SEQ ID NO: 165 - DNA, 35 bp, Artificial Sequence
  Synthetic oligonucleotide
gcgaccactctataacctcaaccgtgctcactcct

SEQ ID NO: 166 - DNA, 37 bp, Artificial Sequence
  Synthetic oligonucleotide
gcgcaagttgtctctaccgtgccccgaaagttttgga

SEQ ID NO: 167 - DNA, 35 bp, Artificial Sequence
  Synthetic oligonucleotide
gcgcaccacctacattgtctccaccgtgctttatt

SEQ ID NO: 168 - DNA, 36 bp, Artificial Sequence
  Synthetic oligonucleotide
gcgcacccacgtgaactctaccgtgcctatttccta

SEQ ID NO: 169 - DNA, 38 bp, Artificial Sequence
  Synthetic oligonucleotide
gcgcaccgacctctaccgtgccaaaataggttatctga

SEQ ID NO: 170 - DNA, 35 bp, Artificial Sequence
  Synthetic oligonucleotide
gcgccaccacacaaaccttccctatcgagggagat

SEQ ID NO: 171 - DNA, 37 bp, Artificial Sequence
  Synthetic oligonucleotide
gcgcggactatattactctactgtgccctgcttatga

SEQ ID NO: 172 - DNA, 35 bp, Artificial Sequence
  Synthetic oligonucleotide
gcggataggacaataacttactccactgtgccatc

SEQ ID NO: 173 - DNA, 35 bp, Artificial Sequence
  Synthetic oligonucleotide
gcggtgacctctactgtgcgccccaagccttagtt

SEQ ID NO: 174 - DNA, 38 bp, Artificial Sequence
  Synthetic oligonucleotide
gcgtacagaacctctaccgtgcccactcacttccatga

SEQ ID NO: 175 - DNA, 35 bp, Artificial Sequence
  Synthetic oligonucleotide
gcgtcccctcccggatggtcctttctctactgtgc

SEQ ID NO: 176 - DNA, 35 bp, Artificial Sequence
  Synthetic oligonucleotide
gcgtgctaacggtatgcaagacgtatgcgattttc

SEQ ID NO: 177 - DNA, 35 bp, Artificial Sequence
  Synthetic oligonucleotide
gctagaccgatccacctcaaacctctactgtgcct

SEQ ID NO: 178 - DNA, 35 bp, Artificial Sequence
  Synthetic oligonucleotide
gctagcttagctctaccgtgcacattccgctattt

SEQ ID NO: 179 - DNA, 35 bp, Artificial Sequence
  Synthetic oligonucleotide
ggtgcaggcaagatattttactctactgtgcattt

SEQ ID NO: 180 - DNA, 35 bp, Artificial Sequence
  Synthetic oligonucleotide
gtaaatgtacatgcgtatcctcacctctactgtgc

SEQ ID NO: 181 - DNA, 35 bp, Artificial Sequence
  Synthetic oligonucleotide
taacacgtctttcactctactgtgccctttatgcc

SEQ ID NO: 182 - DNA, 38 bp, Artificial Sequence
  Synthetic oligonucleotide
taatggcatgcggacctatcctctaccgtgctccttga

SEQ ID NO: 183 - DNA, 35 bp, Artificial Sequence
  Synthetic oligonucleotide
tatgcgatttctctaccgtgccaatatgccttgtt

SEQ ID NO: 184 - DNA, 36 bp, Artificial Sequence
  Synthetic oligonucleotide
tctgcgattctaccgttactctaccgtgccaccaaa

SEQ ID NO: 185 - DNA, 36 bp, Artificial Sequence
  Synthetic oligonucleotide
tgcgcagtcatttcgccatgttctctaccgtgccaa

SEQ ID NO: 186 - DNA, 38 bp, Artificial Sequence
  Synthetic oligonucleotide
tgtcaggcggtagtactctccaccgtgcctattgttga

SEQ ID NO: 187 - DNA, 35 bp, Artificial Sequence
  Synthetic oligonucleotide
acatgcataccctacgaatcgttccatcaccatac

SEQ ID NO: 188 - DNA, 35 bp, Artificial Sequence
  Synthetic oligonucleotide
agtcagtgcgcccgctatttacgatctcactgttc

SEQ ID NO: 189 - DNA, 35 bp, Artificial Sequence
  Synthetic oligonucleotide
agtgcagtcgcgatgggaacttcttctttgcttta

SEQ ID NO: 190 - DNA, 36 bp, Artificial Sequence
  Synthetic oligonucleotide
atggccatgcgaaccgaaacctagcccattttccta

SEQ ID NO: 191 - DNA, 34 bp, Artificial Sequence
  Synthetic oligonucleotide
attgcggtcatccccttccacgctataccaccat

SEQ ID NO: 192 - DNA, 35 bp, Artificial Sequence
  Synthetic oligonucleotide
cactgcaggtcactggcgccctatttcctcacatt

SEQ ID NO: 193 - DNA, 35 bp, Artificial Sequence
  Synthetic oligonucleotide
catgcccgtaaacgcctaatctaccaccttttgct

SEQ ID NO: 194 - DNA, 35 bp, Artificial Sequence
  Synthetic oligonucleotide
catgccgcctttcgacttccatatcccaacacgcc

SEQ ID NO: 195 - DNA, 35 bp, Artificial Sequence
  Synthetic oligonucleotide
catgccggtcattccatactcaaactcattcactc

SEQ ID NO: 196 - DNA, 35 bp, Artificial Sequence
  Synthetic oligonucleotide
catgcgagctacccttatcatctcatgtttgcttt

SEQ ID NO: 197 - DNA, 35 bp, Artificial Sequence
  Synthetic oligonucleotide
catgcgattgcgccccattccttgccttatctcac

SEQ ID NO: 198 - DNA, 36 bp, Artificial Sequence
  Synthetic oligonucleotide
catgcgcacatcgtactccgtagccctaaattatca

SEQ ID NO: 199 - DNA, 35 bp, Artificial Sequence
  Synthetic oligonucleotide
catgcgccctgtgcgttctctactaccctaatcat

SEQ ID NO: 200 - DNA, 38 bp, Artificial Sequence
  Synthetic oligonucleotide
catgtacgcacacccactgattctttaccacccactga

SEQ ID NO: 201 - DNA, 35 bp, Artificial Sequence
  Synthetic oligonucleotide
gcaggacaccccctcattatttgtttcatcctacg

SEQ ID NO: 202 - DNA, 35 bp, Artificial Sequence
  Synthetic oligonucleotide
gcatcaggcgcactttcatttgctaatcgtttttt

SEQ ID NO: 203 - DNA, 35 bp, Artificial Sequence
  Synthetic oligonucleotide
gccatgcgagagggttattgttgatctcatgggtt

SEQ ID NO: 204 - DNA, 35 bp, Artificial Sequence
  Synthetic oligonucleotide
gcgataaagcccatgtaaccctctgaaaacccgat

SEQ ID NO: 205 - DNA, 35 bp, Artificial Sequence
  Synthetic oligonucleotide
gcgccacgagctacccgacttccgattactttctt

SEQ ID NO: 206 - DNA, 35 bp, Artificial Sequence
  Synthetic oligonucleotide
gcggacatcgggcactttatacaaccacctttttg

SEQ ID NO: 207 - DNA, 36 bp, Artificial Sequence
  Synthetic oligonucleotide
gctgcaggccgtcccaaatattcgctcccacacata

SEQ ID NO: 208 - DNA, 35 bp, Artificial Sequence
  Synthetic oligonucleotide
gctggtcaggcgttccacacttcctacccgctttt

SEQ ID NO: 209 - DNA, 35 bp, Artificial Sequence
  Synthetic oligonucleotide
tatgcgcaggaccacctattacacgaccttatcct

SEQ ID NO: 210 - DNA, 35 bp, Artificial Sequence
  Synthetic oligonucleotide
tcaactggggtcagtgccaacgcttactttcttct

SEQ ID NO: 211 - DNA, 35 bp, Artificial Sequence
  Synthetic oligonucleotide
tcaagcagtcatagccggtttcacgctttacttac

SEQ ID NO: 212 - DNA, 35 bp, Artificial Sequence
  Synthetic oligonucleotide
aaaacacgcaaactacctggaaacttgacttcttt

SEQ ID NO: 213 - DNA, 35 bp, Artificial Sequence
  Synthetic oligonucleotide
aaaacactcacgatacctaccctggtcttcacaac

SEQ ID NO: 214 - DNA, 35 bp, Artificial Sequence
  Synthetic oligonucleotide
aaaacagcaggcattttcctgtactttcgaattca

SEQ ID NO: 215 - DNA, 35 bp, Artificial Sequence
  Synthetic oligonucleotide
aaaaccacagctaccattatcgcattggccctact

SEQ ID NO: 216 - DNA, 35 bp, Artificial Sequence
  Synthetic oligonucleotide
aaaacccaagcaccgaacgaactatccctttttct

SEQ ID NO: 217 - DNA, 35 bp, Artificial Sequence
  Synthetic oligonucleotide
aaaacccaccacgcgtcgtacgcataccacccttt

SEQ ID NO: 218 - DNA, 35 bp, Artificial Sequence
  Synthetic oligonucleotide
aaaaccggtcctgcgccttcttctccgcttttatt

SEQ ID NO: 219 - DNA, 35 bp, Artificial Sequence
  Synthetic oligonucleotide
caggtactgtggcaggcgatccattgctctctttt

SEQ ID NO: 220 - DNA, 35 bp, Artificial Sequence
  Synthetic oligonucleotide
caggtcagcagtccaggcgattactttctcttttc

SEQ ID NO: 221 - DNA, 35 bp, Artificial Sequence
  Synthetic oligonucleotide
cagtaaccgctgtctgtcatttttcaacattctgt

SEQ ID NO: 222 - DNA, 36 bp, Artificial Sequence
  Synthetic oligonucleotide
cagtaactgtagtcgtcgaaccttgcttacaaccca

SEQ ID NO: 223 - DNA, 35 bp, Artificial Sequence
  Synthetic oligonucleotide
cagtaaggaagctcatgcggtacaggtctacctcg

SEQ ID NO: 224 - DNA, 38 bp, Artificial Sequence
  Synthetic oligonucleotide
cagtaagtgctgtcactgcgccacttgtaaatacttga

SEQ ID NO: 225 - DNA, 36 bp, Artificial Sequence
  Synthetic oligonucleotide
cagtaatgcgaagctagtacgttctctcttatttta

SEQ ID NO: 226 - DNA, 35 bp, Artificial Sequence
  Synthetic oligonucleotide
cagtacaaacatcgcgattctttccttgatactgt

SEQ ID NO: 227 - DNA, 35 bp, Artificial Sequence
  Synthetic oligonucleotide
gagggcggctctaatgcatgcgctttcatctttgc

SEQ ID NO: 228 - DNA, 36 bp, Artificial Sequence
  Synthetic oligonucleotide
gagggcgggcagtcatttcgattatatctgcctaca

SEQ ID NO: 229 - DNA, 37 bp, Artificial Sequence
  Synthetic oligonucleotide
gagggcggtccaacgcgcaatgtcttttttcttccga

SEQ ID NO: 230 - DNA, 35 bp, Artificial Sequence
  Synthetic oligonucleotide
gagggcgtacaggagtcttgcggtccacattttat

SEQ ID NO: 231 - DNA, 35 bp, Artificial Sequence
  Synthetic oligonucleotide
gagggctactgaagttaatggcattcttctctatc

SEQ ID NO: 232 - DNA, 35 bp, Artificial Sequence
  Synthetic oligonucleotide
gagggctcatgccagccgcttttcttacctttatc

SEQ ID NO: 233 - DNA, 38 bp, Artificial Sequence
  Synthetic oligonucleotide
gagggctgaacaagtagtgcgtacattttccttcctga

SEQ ID NO: 234 - DNA, 35 bp, Artificial Sequence
  Synthetic oligonucleotide
gagggctgcaggcatccaatttcctccttgtccct

SEQ ID NO: 235 - DNA, 35 bp, Artificial Sequence
  Synthetic oligonucleotide
gaggggccgtccttcgtacggaatgtgcatgcgct

SEQ ID NO: 236 - DNA, 35 bp, Artificial Sequence
  Synthetic oligonucleotide
gaggggcggtcattgccgttagcctcctttcgcct

SEQ ID NO: 237 - DNA, 37 bp, Artificial Sequence
  Synthetic oligonucleotide
gcgaaactcgccatatacttaaacttgcccttttgga

SEQ ID NO: 238 - DNA, 38 bp, Artificial Sequence
  Synthetic oligonucleotide
aactgcacgtaaccttaatcactccaccgtgccattga

SEQ ID NO: 239 - DNA, 36 bp, Artificial Sequence
  Synthetic oligonucleotide
ttcgccgttaagcatcgtgtcatgcgcaactgttaa

SEQ ID NO: 240 - DNA, 35 bp, Artificial Sequence
  Synthetic oligonucleotide
acgcggacctagcatatcgtagtgcgtggcacttt

SEQ ID NO: 241 - DNA, 35 bp, Artificial Sequence
  Synthetic oligonucleotide
tatgcgcgccatcaccggaactaggtttgggcttt

SEQ ID NO: 242 - DNA, 35 bp, Artificial Sequence
  Synthetic oligonucleotide
gagtacggaatcgtgtcatcagctggatacttttt

SEQ ID NO: 243 - DNA, 38 bp, Artificial Sequence
  Synthetic oligonucleotide
atgcactgggctgaccggtattgcgtatttctctttga

SEQ ID NO: 244 - DNA, 35 bp, Artificial Sequence
  Synthetic oligonucleotide
tatgccccgttccattcttcattcactactagccc

SEQ ID NO: 245 - DNA, 36 bp, Artificial Sequence
  Synthetic oligonucleotide
aagcacaggtactagcaggttcgcactccctgacta

SEQ ID NO: 246 - DNA, 35 bp, Artificial Sequence
  Synthetic oligonucleotide
cacgccccaatatgccatactctactgtgcccctt

SEQ ID NO: 247 - DNA, 35 bp, Artificial Sequence
  Synthetic oligonucleotide
aatgcgcgctaaagaaggacttgtcttgccagccc

SEQ ID NO: 248 - DNA, 35 bp, Artificial Sequence
  Synthetic oligonucleotide
gaacggatcgtagtgaaacaggactggagcggccc

SEQ ID NO: 249 - DNA, 35 bp, Artificial Sequence
  Synthetic oligonucleotide
tcgtaggacaaaggcactggttgaatcttttctat

SEQ ID NO: 250 - DNA, 35 bp, Artificial Sequence
  Synthetic oligonucleotide
tgcgcgctaaacactgcaagtctagccccgcattc

SEQ ID NO: 251 - DNA, 35 bp, Artificial Sequence
  Synthetic oligonucleotide
tcacctaccaagtctccaatcattgcaccctctac

SEQ ID NO: 252 - DNA, 36 bp, Artificial Sequence
  Synthetic oligonucleotide
gcctatcaatgtctctctactgtgccggacttttta

SEQ ID NO: 253 - DNA, 36 bp, Artificial Sequence
  Synthetic oligonucleotide
aggactgcccccgcctgactctactgtgccatctca

SEQ ID NO: 254 - DNA, 35 bp, Artificial Sequence
  Synthetic oligonucleotide
ggtagctccaccgtgccatactcgatctttgttac

SEQ ID NO: 255 - DNA, 38 bp, Artificial Sequence
  Synthetic oligonucleotide
ttccgcgacctaactccaccgtgccataatccctttga

SEQ ID NO: 256 - DNA, 36 bp, Artificial Sequence
  Synthetic oligonucleotide
agacttaagcaaggtcgtacgtaggtagtcccacca

SEQ ID NO: 257 - DNA, 36 bp, Artificial Sequence
  Synthetic oligonucleotide
gctaactgcaggccccctatccgacctaaatataca

SEQ ID NO: 258 - DNA, 36 bp, Artificial Sequence
  Synthetic oligonucleotide
atcgtagtacgaatgtcaagcgtacacgctttccta

SEQ ID NO: 259 - DNA, 36 bp, Artificial Sequence
  Synthetic oligonucleotide
gcgttgatctctaccgtgcaccgaacactccccaca

SEQ ID NO: 260 - DNA, 38 bp, Artificial Sequence
  Synthetic oligonucleotide
gccgctatatcaatcctctactgtgcgaattaacctga

SEQ ID NO: 261 - DNA, 35 bp, Artificial Sequence
  Synthetic oligonucleotide
ttgctgttatcgtcctctactgtgccggtattcct

SEQ ID NO: 262 - DNA, 35 bp, Artificial Sequence
  Synthetic oligonucleotide
gtcatgcggaagctttcctgttttggtataatgtc

SEQ ID NO: 263 - DNA, 36 bp, Artificial Sequence
  Synthetic oligonucleotide
gcgaacagatttctctacggtgcttacacatattta

SEQ ID NO: 264 - DNA, 36 bp, Artificial Sequence
  Synthetic oligonucleotide
actggaaggagtcctacctgcctgacgcgtgacgta

SEQ ID NO: 265 - DNA, 38 bp, Artificial Sequence
  Synthetic oligonucleotide
gccaatactccactgtgcttgattttacttttgaatga

SEQ ID NO: 266 - DNA, 35 bp, Artificial Sequence
  Synthetic oligonucleotide
tgacctactaagtcagcgcacatcctgggctttct

SEQ ID NO: 267 - DNA, 35 bp, Artificial Sequence
  Synthetic oligonucleotide
tgtctctactgtgcccaattgttcggaaataactt

SEQ ID NO: 268 - DNA, 35 bp, Artificial Sequence
  Synthetic oligonucleotide
aacctctgctgtgcgttaaactctaccgtgcctac

SEQ ID NO: 269 - DNA, 36 bp, Artificial Sequence
  Synthetic oligonucleotide
tacaacgcgtgcttggggtgacgtggtgcctcttta

SEQ ID NO: 270 - DNA, 36 bp, Artificial Sequence
  Synthetic oligonucleotide
tagtcttgccgtctatctctaccgtgcctggcccta

SEQ ID NO: 271 - DNA, 35 bp, Artificial Sequence
  Synthetic oligonucleotide
gcggaactcgcccccttacatcattttttttggtt

SEQ ID NO: 272 - DNA, 35 bp, Artificial Sequence
  Synthetic oligonucleotide
tgcgtgctaaacggtctagcacatgcgggcctcac

SEQ ID NO: 273 - DNA, 38 bp, Artificial Sequence
  Synthetic oligonucleotide
gctgcagtgcgactctggcctccactgtgctaccttga

SEQ ID NO: 274 - DNA, 35 bp, Artificial Sequence
  Synthetic oligonucleotide
ggccacgactggttccccaattcacaggtatacat

SEQ ID NO: 275 - DNA, 35 bp, Artificial Sequence
  Synthetic oligonucleotide
gcgatagccttaacttgccttctgtgaactcgcct

SEQ ID NO: 276 - DNA, 35 bp, Artificial Sequence
  Synthetic oligonucleotide
tcacctactaggtccatccaatacttattgtccca

SEQ ID NO: 277 - DNA, 35 bp, Artificial Sequence
  Synthetic oligonucleotide
catgcggcaagcttttaactcagctttatctcata

SEQ ID NO: 278 - DNA, 38 bp, Artificial Sequence
  Synthetic oligonucleotide
catgacattttctccactgtgcttgtaattagtattga

SEQ ID NO: 279 - DNA, 36 bp, Artificial Sequence
  Synthetic oligonucleotide
aactccaccgtgcccacttcttgtttcatagtttaa

SEQ ID NO: 280 - DNA, 38 bp, Artificial Sequence
  Synthetic oligonucleotide
ccatgcgattttgtttcccctctactgtgcttatctga

SEQ ID NO: 281 - DNA, 35 bp, Artificial Sequence
  Synthetic oligonucleotide
tgttcacctgtccttcctctctactgtgccgttct

SEQ ID NO: 282 - DNA, 35 bp, Artificial Sequence
  Synthetic oligonucleotide
atgcgcgcgatcgaggtccccgatggcttcgctcc

SEQ ID NO: 283 - DNA, 36 bp, Artificial Sequence
  Synthetic oligonucleotide
tccgcgtgtaaccttggcatgtacctagtgtccaca

SEQ ID NO: 284 - DNA, 36 bp, Artificial Sequence
  Synthetic oligonucleotide
catgccaagctttcatttaggatttcgcccacatca

SEQ ID NO: 285 - DNA, 37 bp, Artificial Sequence
  Synthetic oligonucleotide
gcgtctgcgtcctagttttctctaccgtgcttttcga

SEQ ID NO: 286 - DNA, 36 bp, Artificial Sequence
  Synthetic oligonucleotide
ggctgctagacctccaccgtgccctttctttggtta

SEQ ID NO: 287 - DNA, 35 bp, Artificial Sequence
  Synthetic oligonucleotide
gagtcaggcccaggcttacatatcactagctttta

SEQ ID NO: 288 - DNA, 36 bp, Artificial Sequence
  Synthetic oligonucleotide
aatactctactgtgccccccgttttctcatcgatca

SEQ ID NO: 289 - DNA, 35 bp, Artificial Sequence
  Synthetic oligonucleotide
aggcatgcgcagagttaatttttttctctactgtg

SEQ ID NO: 290 - DNA, 36 bp, Artificial Sequence
  Synthetic oligonucleotide
gacctgcagcgcacgcccgatatctctactgtgcca

SEQ ID NO: 291 - DNA, 36 bp, Artificial Sequence
  Synthetic oligonucleotide
ccggggctaggaaagctaccacgtcatgcggaacta

SEQ ID NO: 292 - DNA, 35 bp, Artificial Sequence
  Synthetic oligonucleotide
catctcaaaactttcctctaccgtgcaaacattta

SEQ ID NO: 293 - DNA, 35 bp, Artificial Sequence
  Synthetic oligonucleotide
gcgatcgaacttgcctcctacaatcatcaactagc

SEQ ID NO: 294 - DNA, 38 bp, Artificial Sequence
  Synthetic oligonucleotide
cagtcatcccgtggactctgtgctcgtatctccattga

SEQ ID NO: 295 - DNA, 36 bp, Artificial Sequence
  Synthetic oligonucleotide
tcgtagtacgcggtgaaccctcaatttacgccccta

SEQ ID NO: 296 - DNA, 37 bp, Artificial Sequence
  Synthetic oligonucleotide
gcgtcgtccaactccactgtgcccattttaggtctga

SEQ ID NO: 297 - DNA, 35 bp, Artificial Sequence
  Synthetic oligonucleotide
gcatatgcggtgtttctactctaccgtgcaaaacc

SEQ ID NO: 298 - DNA, 36 bp, Artificial Sequence
  Synthetic oligonucleotide
gcggcaacacttcctctactgtgcttcctggcttaa

SEQ ID NO: 299 - DNA, 35 bp, Artificial Sequence
  Synthetic oligonucleotide
gattcggtccccttcttctctactgtgccttttct

SEQ ID NO: 300 - DNA, 35 bp, Artificial Sequence
  Synthetic oligonucleotide
ccgcgtgcttggtgcgtgctgcaggaaattggaaa

SEQ ID NO: 301 - DNA, 36 bp, Artificial Sequence
  Synthetic oligonucleotide
gcgtgccaacggactggagctctattgattgttcta

SEQ ID NO: 302 - DNA, 35 bp, Artificial Sequence
  Synthetic oligonucleotide
atgtacgtgcgtaccttttatattctctactgtgc

SEQ ID NO: 303 - DNA, 36 bp, Artificial Sequence
  Synthetic oligonucleotide
agagcctgggcttgctagctggatttggtcacgaaa

SEQ ID NO: 304 - DNA, 35 bp, Artificial Sequence
  Synthetic oligonucleotide
tactgcgcgcctggacccgtgtgctagacatgcgc

SEQ ID NO: 305 - DNA, 36 bp, Artificial Sequence
  Synthetic oligonucleotide
ccgtggtgccctgcgcgctaagaggctcacggagta

SEQ ID NO: 306 - DNA, 35 bp, Artificial Sequence
  Synthetic oligonucleotide
gtaccggacctagggactaacgtactggcacctct

SEQ ID NO: 307 - DNA, 36 bp, Artificial Sequence
  Synthetic oligonucleotide
taccgcgagcttgggaagtgctgctacgtctgccga

SEQ ID NO: 308 - DNA, 35 bp, Artificial Sequence
  Synthetic oligonucleotide
ggtatgcccgcttttactctactgtgcccgacata

SEQ ID NO: 309 - DNA, 36 bp, Artificial Sequence
  Synthetic oligonucleotide
gtgcaacactaagttgaccggattgagtctagcgaa

SEQ ID NO: 310 - DNA, 35 bp, Artificial Sequence
  Synthetic oligonucleotide
gactgcagggtgtcacctctaccgtgccatgaggt

SEQ ID NO: 311 - DNA, 35 bp, Artificial Sequence
  Synthetic oligonucleotide
ttcgtagtaccaatagtcagtaatgccctttcgcc

SEQ ID NO: 312 - DNA, 38 bp, Artificial Sequence
  Synthetic oligonucleotide
atgcactgtatgcgggctatgcgaatacctagttatga

SEQ ID NO: 313 - DNA, 36 bp, Artificial Sequence
  Synthetic oligonucleotide
cccggcgcgctacgggacgattatgagctcttgcaa

SEQ ID NO: 314 - DNA, 35 bp, Artificial Sequence
  Synthetic oligonucleotide
catgcgcacaggctttttaatctccatgaagtttc

SEQ ID NO: 315 - DNA, 38 bp, Artificial Sequence
  Synthetic oligonucleotide
gcgggcttacacgtactggaggggttgcatgccattga

SEQ ID NO: 316 - DNA, 35 bp, Artificial Sequence
  Synthetic oligonucleotide
gtcgtagtactcgcggtcaagagattccttatttc

SEQ ID NO: 317 - DNA, 35 bp, Artificial Sequence
  Synthetic oligonucleotide
cacgcgtgcttggcgacgttcacttgcgggcctat

SEQ ID NO: 318 - DNA, 36 bp, Artificial Sequence
  Synthetic oligonucleotide
gccacctcactccactgtgctatcttatcgccttca

SEQ ID NO: 319 - DNA, 36 bp, Artificial Sequence
  Synthetic oligonucleotide
cgtgtcctttgaccgtactgcgaaacgcctaccaaa

SEQ ID NO: 320 - DNA, 35 bp, Artificial Sequence
  Synthetic oligonucleotide
gaatcgtaacaaactgcaggcctatctctacttgt

SEQ ID NO: 321 - DNA, 37 bp, Artificial Sequence
  Synthetic oligonucleotide
gcaggaaacctctactgtgccttgtagtatactttga

SEQ ID NO: 322 - DNA, 38 bp, Artificial Sequence
  Synthetic oligonucleotide
gcagtccatagcgctcctggtctcctcttttgctttga

SEQ ID NO: 323 - DNA, 35 bp, Artificial Sequence
  Synthetic oligonucleotide
cgtgccactcaaatcctcctctaccgtgctttttt

SEQ ID NO: 324 - DNA, 35 bp, Artificial Sequence
  Synthetic oligonucleotide
tggagcacgccgccaatggacagtccaccttacct

SEQ ID NO: 325 - DNA, 35 bp, Artificial Sequence
  Synthetic oligonucleotide
gatgggcctgcgtgctaaggcgcgataacgggtgt

SEQ ID NO: 326 - DNA, 35 bp, Artificial Sequence
  Synthetic oligonucleotide
cgcgggccaggtctgcatgcatgcgaggtcacacc

SEQ ID NO: 327 - DNA, 37 bp, Artificial Sequence
  Synthetic oligonucleotide
gcgtgcttacgaacaaggtgcgtgcccgattctccga

SEQ ID NO: 328 - DNA, 36 bp, Artificial Sequence
  Synthetic oligonucleotide
tcagcggacctagcgaacgattgcggccaccactta

SEQ ID NO: 329 - DNA, 38 bp, Artificial Sequence
  Synthetic oligonucleotide
gccgcgcgtgccagcataatcgtactatgtctgcgtga

SEQ ID NO: 330 - DNA, 35 bp, Artificial Sequence
  Synthetic oligonucleotide
atcgtagaactagctagtctgcaatttctggttac

SEQ ID NO: 331 - DNA, 35 bp, Artificial Sequence
  Synthetic oligonucleotide
gccgcgtgcctggccaaactgggtcaacttttctc

SEQ ID NO: 332 - DNA, 38 bp, Artificial Sequence
  Synthetic oligonucleotide
tctatcgcgtgccagtgtacgtacggtgtcttatttga

SEQ ID NO: 333 - DNA, 35 bp, Artificial Sequence
  Synthetic oligonucleotide
ttacgttcccggactctactgtgcccctccctata

SEQ ID NO: 334 - DNA, 35 bp, Artificial Sequence
  Synthetic oligonucleotide
ccaaccgcgcgcctggggactacgtgacatctagc

SEQ ID NO: 335 - DNA, 36 bp, Artificial Sequence
  Synthetic oligonucleotide
tcgtagtactgctgctttgtgcgtccatactcgtta

SEQ ID NO: 336 - DNA, 37 bp, Artificial Sequence
  Synthetic oligonucleotide
atcgtagtactgcaactgggattattcacacactaga

SEQ ID NO: 337 - DNA, 36 bp, Artificial Sequence
  Synthetic oligonucleotide
gaattccgcgcgtagtcgagtactagggaaatcgaa

SEQ ID NO: 338 - DNA, 35 bp, Artificial Sequence
  Synthetic oligonucleotide
catgcggaccatgatttttattgagtttttgcttt

SEQ ID NO: 339 - DNA, 35 bp, Artificial Sequence
  Synthetic oligonucleotide
attcgagcggtcttgcgggtatccctccactgtgc

SEQ ID NO: 340 - DNA, 36 bp, Artificial Sequence
  Synthetic oligonucleotide
catgcgcattactctggtcaacttgccgaatcgaaa

SEQ ID NO: 341 - DNA, 37 bp, Artificial Sequence
  Synthetic oligonucleotide
gggcgtatcgtagccacgtacaagggttgcatattga

SEQ ID NO: 342 - DNA, 36 bp, Artificial Sequence
  Synthetic oligonucleotide
gcgagaagctttcaatcctcaaccttacgctttata

SEQ ID NO: 343 - DNA, 35 bp, Artificial Sequence
  Synthetic oligonucleotide
acgcctaagttgcctctaccgtgccgagccctcca

SEQ ID NO: 344 - DNA, 35 bp, Artificial Sequence
  Synthetic oligonucleotide
tgcggagctagcaacgagggtagagtgcgaattcc

SEQ ID NO: 345 - DNA, 35 bp, Artificial Sequence
  Synthetic oligonucleotide
gataagtcacggacggtttctctactgtgcctttt

SEQ ID NO: 346 - DNA, 36 bp, Artificial Sequence
  Synthetic oligonucleotide
gcgtgccaacaacctgcggacaaaagaccccctaaa

SEQ ID NO: 347 - DNA, 38 bp, Artificial Sequence
  Synthetic oligonucleotide
ggtcatgccgctaggggcgaactcctctgagcctgtga

SEQ ID NO: 348 - DNA, 38 bp, Artificial Sequence
  Synthetic oligonucleotide
cctcgcgcgccagggacgttgcaagttaaaccatatga

SEQ ID NO: 349 - DNA, 35 bp, Artificial Sequence
  Synthetic oligonucleotide
gcaggcgggccaggcttaatacacgcttctactta

SEQ ID NO: 350 - DNA, 34 bp, Artificial Sequence
  Synthetic oligonucleotide
atcgtagtaatgcagcaattgcaatactcctatt

SEQ ID NO: 351 - DNA, 36 bp, Artificial Sequence
  Synthetic oligonucleotide
accgaacctagggacgccccaggaatcacaatgtta

SEQ ID NO: 352 - DNA, 35 bp, Artificial Sequence
  Synthetic oligonucleotide
tactgctaactttcactctaccgtgcaaaccacca

SEQ ID NO: 353 - DNA, 35 bp, Artificial Sequence
  Synthetic oligonucleotide
cccggaagtgggttcgagctgcatcgtgtcaggcc

SEQ ID NO: 354 - DNA, 36 bp, Artificial Sequence
  Synthetic oligonucleotide
tagtaacttcatgcccccagtggaactcctctgaca

SEQ ID NO: 355 - DNA, 35 bp, Artificial Sequence
  Synthetic oligonucleotide
gtccacgcgtgcctgaggacacagccaggaaactt

SEQ ID NO: 356 - DNA, 36 bp, Artificial Sequence
  Synthetic oligonucleotide
aatcgctggccagaaagttagcagtcgaggcccaaa

SEQ ID NO: 357 - DNA, 36 bp, Artificial Sequence
  Synthetic oligonucleotide
agggcgtgccacctcgaacacgcaggtaatttttca

SEQ ID NO: 358 - DNA, 35 bp, Artificial Sequence
  Synthetic oligonucleotide
tcacctaccatgtccgagtaacactcgcccctcca

SEQ ID NO: 359 - DNA, 35 bp, Artificial Sequence
  Synthetic oligonucleotide
cgtggccggtggtccgtactgccaaaatatttaca

SEQ ID NO: 360 - DNA, 35 bp, Artificial Sequence
  Synthetic oligonucleotide
cgcgtgccagcggactttcaccatgcgatacgtgg

SEQ ID NO: 361 - DNA, 36 bp, Artificial Sequence
  Synthetic oligonucleotide
gagttaaagctatctctaccgtgccccctaaagtta

SEQ ID NO: 362 - DNA, 36 bp, Artificial Sequence
  Synthetic oligonucleotide
tatcgcgcgccagaagagtaagcaagtcatgaccca

SEQ ID NO: 363 - DNA, 37 bp, Artificial Sequence
  Synthetic oligonucleotide
tgaccaagggttccgctgtggggatacggttaaggga

SEQ ID NO: 364 - DNA, 36 bp, Artificial Sequence
  Synthetic oligonucleotide
agccggagctaggctagtgcgcaccagtcaaaccta

SEQ ID NO: 365 - DNA, 38 bp, Artificial Sequence
  Synthetic oligonucleotide
tcgtagtattgcaagggcaccttactcccaccatttga

SEQ ID NO: 366 - DNA, 35 bp, Artificial Sequence
  Synthetic oligonucleotide
gcgcagcttatcgccatccgcaaatccacacgctt

SEQ ID NO: 367 - DNA, 37 bp, Artificial Sequence
  Synthetic oligonucleotide
cccacgcgtgcctgtggatggcgcactcgggcataga

SEQ ID NO: 368 - DNA, 36 bp, Artificial Sequence
  Synthetic oligonucleotide
caaggagcacgtatgcactgtgcgagttggtccgta

SEQ ID NO: 369 - DNA, 36 bp, Artificial Sequence
  Synthetic oligonucleotide
agttagtctctaccgtgcccattattccgttctgaa

SEQ ID NO: 370 - DNA, 35 bp, Artificial Sequence
  Synthetic oligonucleotide
gcctgtgaaccttaaactctaccgtgcctctttgt

SEQ ID NO: 371 - DNA, 36 bp, Artificial Sequence
  Synthetic oligonucleotide
gctaaccaagtcatgggaccacgctctattgggata

SEQ ID NO: 372 - DNA, 35 bp, Artificial Sequence
  Synthetic oligonucleotide
gcaggcattattagtgtctctaccgtgctctggac

SEQ ID NO: 373 - DNA, 38 bp, Artificial Sequence
  Synthetic oligonucleotide
taccgcgcgcctggtagttgcagtattcctttgtttga

SEQ ID NO: 374 - DNA, 35 bp, Artificial Sequence
  Synthetic oligonucleotide
taacctaccaggccatgcgcaggactgtaatgcca

SEQ ID NO: 375 - DNA, 36 bp, Artificial Sequence
  Synthetic oligonucleotide
gcgccacatcgcaagcttatcgacaccccgctttca

SEQ ID NO: 376 - DNA, 35 bp, Artificial Sequence
  Synthetic oligonucleotide
cccggggctagggatcgggtgcaatcattgaattt

SEQ ID NO: 377 - DNA, 35 bp, Artificial Sequence
  Synthetic oligonucleotide
gcgagcctagcccgtaactggaaggccactactct

SEQ ID NO: 378 - DNA, 37 bp, Artificial Sequence
  Synthetic oligonucleotide
gacgggtgcgggctagcaagctttacctctattatga

SEQ ID NO: 379 - DNA, 35 bp, Artificial Sequence
  Synthetic oligonucleotide
gcgtgccaacgtgactgtgtcgcctttgctctgta

SEQ ID NO: 380 - DNA, 35 bp, Artificial Sequence
  Synthetic oligonucleotide
atcgtaggactgcgaaatcattgcgggtttattgt

SEQ ID NO: 381 - DNA, 35 bp, Artificial Sequence
  Synthetic oligonucleotide
ttacctaccaaggcacgccgttttatataaggtgg

SEQ ID NO: 382 - DNA, 35 bp, Artificial Sequence
  Synthetic oligonucleotide
ccgcgtgcttggattgtgcagtcctccctctgact

SEQ ID NO: 383 - DNA, 36 bp, Artificial Sequence
  Synthetic oligonucleotide
ttacctaccagtgcatggcgataagtctttcctata

SEQ ID NO: 384 - DNA, 35 bp, Artificial Sequence
  Synthetic oligonucleotide
gacgtctgcaggtgagcattggtctacttattggt

SEQ ID NO: 385 - DNA, 38 bp, Artificial Sequence
  Synthetic oligonucleotide
cgcgatcgtagcagtacggaggttcttctagcatatga

SEQ ID NO: 386 - DNA, 35 bp, Artificial Sequence
  Synthetic oligonucleotide
cgcgaatcgtagccgacgtgcttgggcttgcgacc

SEQ ID NO: 387 - DNA, 36 bp, Artificial Sequence
  Synthetic oligonucleotide
aagcacggtacgcacagtccgacttttgccttcaaa

SEQ ID NO: 388 - DNA, 35 bp, Artificial Sequence
  Synthetic oligonucleotide
tccggaactaggagacgtacacgccgcaatgcccc

SEQ ID NO: 389 - DNA, 35 bp, Artificial Sequence
  Synthetic oligonucleotide
ccgcggacctagcgaggacagcgcattgctagcta

SEQ ID NO: 390 - DNA, 35 bp, Artificial Sequence
  Synthetic oligonucleotide
agcccgcgtgcctgggagacgacctccgacttgcg

SEQ ID NO: 391 - DNA, 35 bp, Artificial Sequence
  Synthetic oligonucleotide
gcgtgctaaggtactgtacagtctacgcctatgtt

SEQ ID NO: 392 - DNA, 38 bp, Artificial Sequence
  Synthetic oligonucleotide
taccgcgatactgcacgtgtgcgaccgcttttccttga

SEQ ID NO: 393 - DNA, 36 bp, Artificial Sequence
  Synthetic oligonucleotide
tgacctaccaaggagagtttcatttgatctaaacta

SEQ ID NO: 394 - DNA, 35 bp, Artificial Sequence
  Synthetic oligonucleotide
cttagtgccctaagtctgcgtgactctactgtgcc

SEQ ID NO: 395 - DNA, 36 bp, Artificial Sequence
  Synthetic oligonucleotide
tgcaggcagagcccgttaagctttttatcaactcca

SEQ ID NO: 396 - DNA, 35 bp, Artificial Sequence
  Synthetic oligonucleotide
gaggcgaatcgtagctccacgtggtgccatgcaga

SEQ ID NO: 397 - DNA, 35 bp, Artificial Sequence
  Synthetic oligonucleotide
catccgctagttgcttttaatgaccaccgcttcca

SEQ ID NO: 398 - DNA, 36 bp, Artificial Sequence
  Synthetic oligonucleotide
aagcactgtacaaactggatgcgtacacttcctcca

SEQ ID NO: 399 - DNA, 35 bp, Artificial Sequence
  Synthetic oligonucleotide
gcgtgccaaggtacggaaggtccatgcaacggttt

SEQ ID NO: 400 - DNA, 36 bp, Artificial Sequence
  Synthetic oligonucleotide
cgtgtaccgcttgtaccgtacaaagtcaccttgtta

SEQ ID NO: 401 - DNA, 36 bp, Artificial Sequence
  Synthetic oligonucleotide
catgcgcgctccactggtcttaattttcctccatga

SEQ ID NO: 402 - DNA, 37 bp, Artificial Sequence
  Synthetic oligonucleotide
tctgcgtgctaagagcggccctgtagttgcgccttga

SEQ ID NO: 403 - DNA, 36 bp, Artificial Sequence
  Synthetic oligonucleotide
gcgtgccaacgattctgcgctgggctagtaccatta

SEQ ID NO: 404 - DNA, 35 bp, Artificial Sequence
  Synthetic oligonucleotide
gcgcgctaacggacaaatcccctaacctcgataaa

SEQ ID NO: 405 - DNA, 35 bp, Artificial Sequence
  Synthetic oligonucleotide
attctctaccgtgccacattttatcctctgcaaac

SEQ ID NO: 406 - DNA, 37 bp, Artificial Sequence
  Synthetic oligonucleotide
tgtctggatgccatgcgccacgcttttctcactatga

SEQ ID NO: 407 - DNA, 37 bp, Artificial Sequence
  Synthetic oligonucleotide
atcgtagtgctgcaggatctacctacattattctgga

SEQ ID NO: 408 - DNA, 36 bp, Artificial Sequence
  Synthetic oligonucleotide
gcagtctcatctgtcttctctaccgtgctcgaatca

SEQ ID NO: 409 - DNA, 35 bp, Artificial Sequence
  Synthetic oligonucleotide
gtctccggcgatatctccactgtgcccttctctat

SEQ ID NO: 410 - DNA, 35 bp, Artificial Sequence
  Synthetic oligonucleotide
gcaagtcattccagtcctgactctaccgtgcttac

SEQ ID NO: 411 - DNA, 35 bp, Artificial Sequence
  Synthetic oligonucleotide
gtgatggtcgtgcccgctttatcttacatctgctt

SEQ ID NO: 412 - DNA, 35 bp, Artificial Sequence
  Synthetic oligonucleotide
gcgtcgacgagatttttgacctctaccgtgccgac

SEQ ID NO: 413 - DNA, 35 bp, Artificial Sequence
  Synthetic oligonucleotide
tgcgtcaggcgtccgcttttaccccaccatgcttt

SEQ ID NO: 414 - DNA, 37 bp, Artificial Sequence
  Synthetic oligonucleotide
atgacacgcgcgcctgctagtactgcgctccatgcga

SEQ ID NO: 415 - DNA, 36 bp, Artificial Sequence
  Synthetic oligonucleotide
ggtcaagcattgcgactctaccgtgcctcaaactaa

SEQ ID NO: 416 - DNA, 35 bp, Artificial Sequence
  Synthetic oligonucleotide
cacgtactgtttactctaccgtgcattaaacgttt

SEQ ID NO: 417 - DNA, 35 bp, Artificial Sequence
  Synthetic oligonucleotide
agcaggcccttttcacatactctctactgtgctcc

SEQ ID NO: 418 - DNA, 35 bp, Artificial Sequence
  Synthetic oligonucleotide
taatgcaggagtgtgccaagcttttatttcatgtc

SEQ ID NO: 419 - DNA, 38 bp, Artificial Sequence
  Synthetic oligonucleotide
catgcgaccgctttacctacataggattactcttctga

SEQ ID NO: 420 - DNA, 35 bp, Artificial Sequence
  Synthetic oligonucleotide
ttgcggatctagcaacgaatggaaggaacacgtac

SEQ ID NO: 421 - DNA, 35 bp, Artificial Sequence
  Synthetic oligonucleotide
atcgtagtacccgcgggaaaaaaccacttatcatc

SEQ ID NO: 422 - DNA, 35 bp, Artificial Sequence
  Synthetic oligonucleotide
tcgctgcaccgtgtccatgcggctacaccaattcg

SEQ ID NO: 423 - DNA, 35 bp, Artificial Sequence
  Synthetic oligonucleotide
gcagaataccttactctaccgtgccattaatacat

SEQ ID NO: 424 - DNA, 38 bp, Artificial Sequence
  Synthetic oligonucleotide
gcgccgaatagcctctactgtgcgttaccctggattga

SEQ ID NO: 425 - DNA, 35 bp, Artificial Sequence
  Synthetic oligonucleotide
gcaggccgtatcactctaccgtgcaaaaagtatac

SEQ ID NO: 426 - DNA, 37 bp, Artificial Sequence
  Synthetic oligonucleotide
tactgaggcgacaattctctaccgtgcccccatttga

SEQ ID NO: 427 - DNA, 37 bp, Artificial Sequence
  Synthetic oligonucleotide
gccactagtatcctccactgtgcaaaattacaataga

SEQ ID NO: 428 - DNA, 38 bp, Artificial Sequence
  Synthetic oligonucleotide
ggtattgccgtgtagttcgttctctactgtgcctttga

SEQ ID NO: 429 - DNA, 35 bp, Artificial Sequence
  Synthetic oligonucleotide
cttgcgagattagctttatcacctgttttccgctt

SEQ ID NO: 430 - DNA, 35 bp, Artificial Sequence
  Synthetic oligonucleotide
gcacctctactgtgcccacaacgaattggactcac

SEQ ID NO: 431 - DNA, 35 bp, Artificial Sequence
  Synthetic oligonucleotide
ctccgcggtcatccactgctccattcaactcgcct

SEQ ID NO: 432 - DNA, 35 bp, Artificial Sequence
  Synthetic oligonucleotide
aatctccaccgtgcactatcttgtctcaaagtttc

SEQ ID NO: 433 - DNA, 36 bp, Artificial Sequence
  Synthetic oligonucleotide
gctagctgaattcaccatatctctactgtgcactaa

SEQ ID NO: 434 - DNA, 37 bp, Artificial Sequence
  Synthetic oligonucleotide
ctgcgtgctaagacgtacggtgtcaacatctctccga

SEQ ID NO: 435 - DNA, 35 bp, Artificial Sequence
  Synthetic oligonucleotide
gcgacgggacttagcttatattagatttcgcttct

SEQ ID NO: 436 - DNA, 36 bp, Artificial Sequence
  Synthetic oligonucleotide
catgcggaagcttactcatttttattcgattaccaa

SEQ ID NO: 437 - DNA, 35 bp, Artificial Sequence
  Synthetic oligonucleotide
taacctaccaagcaatcaccgttttggaaatcatt

SEQ ID NO: 438 - DNA, 36 bp, Artificial Sequence
  Synthetic oligonucleotide
gcccagaaaaactctactgtgcgatgacctgttaaa

SEQ ID NO: 439 - DNA, 36 bp, Artificial Sequence
  Synthetic oligonucleotide
tccgcgtgcctggaaaggtactgtccacttgaacaa

SEQ ID NO: 440 - DNA, 38 bp, Artificial Sequence
  Synthetic oligonucleotide
gagtttgcaggcttggggactctactgtgcaattttga

SEQ ID NO: 441 - DNA, 36 bp, Artificial Sequence
  Synthetic oligonucleotide
ttcgcctccaccgtgcatttctaactttatttctta

SEQ ID NO: 442 - DNA, 35 bp, Artificial Sequence
  Synthetic oligonucleotide
ccctcggactgagcactgcatacaagaagccttgc

SEQ ID NO: 443 - DNA, 37 bp, Artificial Sequence
  Synthetic oligonucleotide
cccgtgcctccccttatctctaccgtgcctcctatga

SEQ ID NO: 444 - DNA, 36 bp, Artificial Sequence
  Synthetic oligonucleotide
actcagtcatcgtacgctttccgatatcgctttata

SEQ ID NO: 445 - DNA, 35 bp, Artificial Sequence
  Synthetic oligonucleotide
tacgcgtgccaggaactgtaccagtcttatgccgc

SEQ ID NO: 446 - DNA, 36 bp, Artificial Sequence
  Synthetic oligonucleotide
gcggatttggtctctaccgtgcctactactagttaa

SEQ ID NO: 447 - DNA, 38 bp, Artificial Sequence
  Synthetic oligonucleotide
ggcacggaatgcatcgtgtcatggcgtctttcccctga

SEQ ID NO: 448 - DNA, 35 bp, Artificial Sequence
  Synthetic oligonucleotide
gtgcaggccacccagatctctactgtgcctcttac

SEQ ID NO: 449 - DNA, 35 bp, Artificial Sequence
  Synthetic oligonucleotide
atcgtaggactgcacatcgtagtttagttactcac

SEQ ID NO: 450 - DNA, 35 bp, Artificial Sequence
  Synthetic oligonucleotide
tcacctacaaatgtcaggcatatactactctatta

SEQ ID NO: 451 - DNA, 36 bp, Artificial Sequence
  Synthetic oligonucleotide
gtacaagcagtttggcgtatatctctactgtgctga

SEQ ID NO: 452 - DNA, 35 bp, Artificial Sequence
  Synthetic oligonucleotide
gataacgtttgattactccactgtgccataccctt

SEQ ID NO: 453 - DNA, 37 bp, Artificial Sequence
  Synthetic oligonucleotide
tgagcgatcgtagccaacgtactgcctttcctattga

SEQ ID NO: 454 - DNA, 35 bp, Artificial Sequence
  Synthetic oligonucleotide
gcgtcgaccacgttaatatttaccctctactgtgc

SEQ ID NO: 455 - DNA, 35 bp, Artificial Sequence
  Synthetic oligonucleotide
gcctggtcaactcgccgcaatacttttacccatcc

SEQ ID NO: 456 - DNA, 37 bp, Artificial Sequence
  Synthetic oligonucleotide
gtcaccctaaccgtattctccaccgtgccttacttga

SEQ ID NO: 457 - DNA, 35 bp, Artificial Sequence
  Synthetic oligonucleotide
gatagaattgagctctactgtgcctatctggttat

SEQ ID NO: 458 - DNA, 35 bp, Artificial Sequence
  Synthetic oligonucleotide
gtccaaattagctctctactgtgcctatccgttaa

SEQ ID NO: 459 - DNA, 37 bp, Artificial Sequence
  Synthetic oligonucleotide
gcgcacttgttcttcttggtcgcggcgtgccacgcga

SEQ ID NO: 460 - DNA, 36 bp, Artificial Sequence
  Synthetic oligonucleotide
gcggtcagagctaattctgtcaactcgccctttcta

SEQ ID NO: 461 - DNA, 36 bp, Artificial Sequence
  Synthetic oligonucleotide
gagcggaactagcgatgcgtacaaggttaatttcta

SEQ ID NO: 462 - DNA, 35 bp, Artificial Sequence
  Synthetic oligonucleotide
aacactctactgtgcctccacgatattttcatact

SEQ ID NO: 463 - DNA, 35 bp, Artificial Sequence
  Synthetic oligonucleotide
gtagtgatgccacctcaactgtgcccttgttttct

SEQ ID NO: 464 - DNA, 36 bp, Artificial Sequence
  Synthetic oligonucleotide
ttcctgcagttctattctctactgtgccctttgtta

SEQ ID NO: 465 - DNA, 37 bp, Artificial Sequence
  Synthetic oligonucleotide
gactgctctcatagtatgaactccactgtgcccttga

SEQ ID NO: 466 - DNA, 38 bp, Artificial Sequence
  Synthetic oligonucleotide
accatgcgcgcaaccttctctaccgtgcatctttttga

SEQ ID NO: 467 - DNA, 36 bp, Artificial Sequence
  Synthetic oligonucleotide
gcgttatacctccactgtgctcaattttcatctaaa

SEQ ID NO: 468 - DNA, 38 bp, Artificial Sequence
  Synthetic oligonucleotide
acgcgtgcctggtttactgcagacgagccccttcatga

SEQ ID NO: 469 - DNA, 38 bp, Artificial Sequence
  Synthetic oligonucleotide
gcacacacactttactctaccgtgccattttgaagtga

SEQ ID NO: 470 - DNA, 38 bp, Artificial Sequence
  Synthetic oligonucleotide
atctgcgggcatccatagataatactctactgtgctga

SEQ ID NO: 471 - DNA, 35 bp, Artificial Sequence
  Synthetic oligonucleotide
aaatcattcctgtggtctctctaccgtgccaatat

SEQ ID NO: 472 - DNA, 36 bp, Artificial Sequence
  Synthetic oligonucleotide
gccataacctatctctactgtgctaaaccggttaca

SEQ ID NO: 473 - DNA, 38 bp, Artificial Sequence
  Synthetic oligonucleotide
gcgactctacggaaatttgggatctctaccgtgcctga

SEQ ID NO: 474 - DNA, 35 bp, Artificial Sequence
  Synthetic oligonucleotide
acctctactgtgccgattccattgttcttccactc

SEQ ID NO: 475 - DNA, 35 bp, Artificial Sequence
  Synthetic oligonucleotide
gcgaccaagccattccaaactagccctgatttcaa

SEQ ID NO: 476 - DNA, 36 bp, Artificial Sequence
  Synthetic oligonucleotide
ctgtacggctgtctgggcctagtattcccgctttaa

SEQ ID NO: 477 - DNA, 36 bp, Artificial Sequence
  Synthetic oligonucleotide
gggaactgcaggttaaactctactgtgctatgttta

SEQ ID NO: 478 - DNA, 36 bp, Artificial Sequence
  Synthetic oligonucleotide
gcgtgggttcctctaccgtgccgaggttgttcctaa

SEQ ID NO: 479 - DNA, 38 bp, Artificial Sequence
  Synthetic oligonucleotide
tcgcggtcagcaattctccaccgtgcgattacctttga

SEQ ID NO: 480 - DNA, 36 bp, Artificial Sequence
  Synthetic oligonucleotide
tacacgtcaccttactctactgtgccgtaatcctca

SEQ ID NO: 481 - DNA, 38 bp, Artificial Sequence
  Synthetic oligonucleotide
atgcactgtacgcaggtcacgcgttttaccactactga

SEQ ID NO: 482 - DNA, 38 bp, Artificial Sequence
  Synthetic oligonucleotide
gttgcgtgctaacacacgtgactgcctatttcctatga

SEQ ID NO: 483 - DNA, 38 bp, Artificial Sequence
  Synthetic oligonucleotide
gctactgcgataactctaccgtgccactcccttgttga

SEQ ID NO: 484 - DNA, 36 bp, Artificial Sequence
  Synthetic oligonucleotide
tatccaaccactagtaagcctccaccgtgccattta

SEQ ID NO: 485 - DNA, 37 bp, Artificial Sequence
  Synthetic oligonucleotide
gctagttaccagtaacctctaccgtgcctcttctgga

SEQ ID NO: 486 - DNA, 36 bp, Artificial Sequence
  Synthetic oligonucleotide
cggcgaactcctctgtagcagtcgtgcggttcataa

SEQ ID NO: 487 - DNA, 35 bp, Artificial Sequence
  Synthetic oligonucleotide
aactgcgtgcctagtacggacttgcacccttgtgg

SEQ ID NO: 488 - DNA, 35 bp, Artificial Sequence
  Synthetic oligonucleotide
gcaggatccgttctttcaactcgcctatttctgga

SEQ ID NO: 489 - DNA, 35 bp, Artificial Sequence
  Synthetic oligonucleotide
actgcgaagccttgcatccaattactctactgtgc

SEQ ID NO: 490 - DNA, 35 bp, Artificial Sequence
  Synthetic oligonucleotide
gcgataatcttgtcattactctaccgtgccgttta

SEQ ID NO: 491 - DNA, 36 bp, Artificial Sequence
  Synthetic oligonucleotide
atgccggcctattactacctaactctactgtgctta

SEQ ID NO: 492 - DNA, 37 bp, Artificial Sequence
  Synthetic oligonucleotide
gcgatcaagcgtatttcttcttacctctactgtgcga

SEQ ID NO: 493 - DNA, 38 bp, Artificial Sequence
  Synthetic oligonucleotide
gatgacacgccctttccactccactgtgcctgttttga

SEQ ID NO: 494 - DNA, 36 bp, Artificial Sequence
  Synthetic oligonucleotide
tacatactccactgtgccacctttcccgactttcca

SEQ ID NO: 495 - DNA, 35 bp, Artificial Sequence
  Synthetic oligonucleotide
catgcaagattttgcgtaacttaattaattgcttt

SEQ ID NO: 496 - DNA, 35 bp, Artificial Sequence
  Synthetic oligonucleotide
gcactatatccgtacctaaacctccactgtgcttt

SEQ ID NO: 497 - DNA, 35 bp, Artificial Sequence
  Synthetic oligonucleotide
gcgctataactccgatgtattctccaccgtgccca

SEQ ID NO: 498 - DNA, 36 bp, Artificial Sequence
  Synthetic oligonucleotide
atcgtagtgctgcaggaaacgagattgatgcaccca

SEQ ID NO: 499 - DNA, 35 bp, Artificial Sequence
  Synthetic oligonucleotide
tgcgagtgggatttcgtccgacacctcaccatgca

SEQ ID NO: 500 - DNA, 35 bp, Artificial Sequence
  Synthetic oligonucleotide
agggtcatctagaacggttgacacgaaccgttgct

SEQ ID NO: 501 - DNA, 35 bp, Artificial Sequence
  Synthetic oligonucleotide
gctaggaaaggacccaaatctctactgtgcctacc

SEQ ID NO: 502 - DNA, 35 bp, Artificial Sequence
  Synthetic oligonucleotide
gcgaggaatacctatctctactgtgccaccaaacg

SEQ ID NO: 503 - DNA, 36 bp, Artificial Sequence
  Synthetic oligonucleotide
gccgtttactctaccgtgccgtatcgatttccatta

SEQ ID NO: 504 - DNA, 35 bp, Artificial Sequence
  Synthetic oligonucleotide
aggtcgtgcgtcccgttcaactagccctgttctca

SEQ ID NO: 505 - DNA, 35 bp, Artificial Sequence
  Synthetic oligonucleotide
cattgcgttctggctttcgttcattttcgctttac

SEQ ID NO: 506 - DNA, 35 bp, Artificial Sequence
  Synthetic oligonucleotide
gcactcatcgcggattatctccaccgtgccgacct

SEQ ID NO: 507 - DNA, 35 bp, Artificial Sequence
  Synthetic oligonucleotide
catgccagctttaactttgagatctgttagttttc

SEQ ID NO: 508 - DNA, 36 bp, Artificial Sequence
  Synthetic oligonucleotide
gccaggatctcaactgtgccattgcctttttctgaa

SEQ ID NO: 509 - DNA, 38 bp, Artificial Sequence
  Synthetic oligonucleotide
ttacctccaccgtgccaatcactgtttgatcgccttga

SEQ ID NO: 510 - DNA, 36 bp, Artificial Sequence
  Synthetic oligonucleotide
taacctaccaagtccaatttggagtctctacgatta

SEQ ID NO: 511 - DNA, 35 bp, Artificial Sequence
  Synthetic oligonucleotide
gcctcaacttgagtttctatcattctccactgtgc

SEQ ID NO: 512 - DNA, 37 bp, Artificial Sequence
  Synthetic oligonucleotide
catagctgcatactctaccgtgcactcattccctaga

SEQ ID NO: 513 - DNA, 37 bp, Artificial Sequence
  Synthetic oligonucleotide
gacatcaactgcgaactcccctgagtgtgatatcgga

SEQ ID NO: 514 - DNA, 35 bp, Artificial Sequence
  Synthetic oligonucleotide
tatctccaccgtgcccgttaataatctgatctgaa

SEQ ID NO: 515 - DNA, 36 bp, Artificial Sequence
  Synthetic oligonucleotide
tgcgtgccaaacggactcaaggtaccatgcatcaca

SEQ ID NO: 516 - DNA, 36 bp, Artificial Sequence
  Synthetic oligonucleotide
acatagactgccgagcgttcttctctaccgtgccca

SEQ ID NO: 517 - DNA, 36 bp, Artificial Sequence
  Synthetic oligonucleotide
atgaccgaggtacccgacggcctcataggatccata

SEQ ID NO: 518 - DNA, 35 bp, Artificial Sequence
  Synthetic oligonucleotide
gcggttatggggttctcaactgtgccaatctccat

SEQ ID NO: 519 - DNA, 35 bp, Artificial Sequence
  Synthetic oligonucleotide
gggtcatgcgatttctttgttcactcaactcgccc

SEQ ID NO: 520 - DNA, 37 bp, Artificial Sequence
  Synthetic oligonucleotide
gctgttgcgtccatatctccactgtgcttttggttga

SEQ ID NO: 521 - DNA, 35 bp, Artificial Sequence
  Synthetic oligonucleotide
atgcgtgccaatacgacgtcaggccatgaagccat

SEQ ID NO: 522 - DNA, 36 bp, Artificial Sequence
  Synthetic oligonucleotide
atgaactggtggacctttatcctctactgtgcaaaa

SEQ ID NO: 523 - DNA, 35 bp, Artificial Sequence
  Synthetic oligonucleotide
ccgcgtgcctggaccttgcacgacatgcggcaata

SEQ ID NO: 524 - DNA, 38 bp, Artificial Sequence
  Synthetic oligonucleotide
tctgcgggctagtatctaatgatctctaccgtgcttga

SEQ ID NO: 525 - DNA, 34 bp, Artificial Sequence
  Synthetic oligonucleotide
catgcggaggcttttaacaccatgcattctcacc

SEQ ID NO: 526 - DNA, 37 bp, Artificial Sequence
  Synthetic oligonucleotide
ttacgtatctgagcgctagtaccagtacctcgagtga

SEQ ID NO: 527 - DNA, 35 bp, Artificial Sequence
  Synthetic oligonucleotide
agtcaggcccgcttttatttttgtggttatttttg

SEQ ID NO: 528 - DNA, 38 bp, Artificial Sequence
  Synthetic oligonucleotide
cttgccctccgacatgaactctactgtgcaacctatga

SEQ ID NO: 529 - DNA, 32 bp, Artificial Sequence
  Synthetic oligonucleotide
atcgcgtgccagaacgtaactcgcccatcgac

SEQ ID NO: 530 - DNA, 35 bp, Artificial Sequence
  Synthetic oligonucleotide
tgacgcgtgcttggcaacgtggcaggacaattatt

SEQ ID NO: 531 - DNA, 36 bp, Artificial Sequence
  Synthetic oligonucleotide
accgcgtgattggaagatactgcgtcttcgatttaa

SEQ ID NO: 532 - DNA, 35 bp, Artificial Sequence
  Synthetic oligonucleotide
gtgtgctgaccttagcaaccgaactgaggccctac

SEQ ID NO: 533 - DNA, 36 bp, Artificial Sequence
  Synthetic oligonucleotide
gcgcgccaaggtactgcggatagcgcattggacaca

SEQ ID NO: 534 - DNA, 35 bp, Artificial Sequence
  Synthetic oligonucleotide
taccgacgcgctattttctactctactgtgctcat

SEQ ID NO: 535 - DNA, 35 bp, Artificial Sequence
  Synthetic oligonucleotide
aaccgaacgtccgataaactcgccctactaatact

SEQ ID NO: 536 - DNA, 35 bp, Artificial Sequence
  Synthetic oligonucleotide
accaggtccactttcggtgatagaccctgcacaca

SEQ ID NO: 537 - DNA, 35 bp, Artificial Sequence
  Synthetic oligonucleotide
taaattgcccgtttgttctctactgtgccactccg

SEQ ID NO: 538 - DNA, 38 bp, Artificial Sequence
  Synthetic oligonucleotide
gccaccttgactctgatccaactctactgtgccattga

SEQ ID NO: 539 - DNA, 38 bp, Artificial Sequence
  Synthetic oligonucleotide
cgtgccaccgctggcttcctacttcgctttaactatga

SEQ ID NO: 540 - DNA, 35 bp, Artificial Sequence
  Synthetic oligonucleotide
tgttctctactgtgcccgataacacgcttttgttc

SEQ ID NO: 541 - DNA, 36 bp, Artificial Sequence
  Synthetic oligonucleotide
ctggtgctgcaccgtgtcacctatctttacgcatta

SEQ ID NO: 542 - DNA, 36 bp, Artificial Sequence
  Synthetic oligonucleotide
atcgtagtacgaagctagccataacctgttatctca

SEQ ID NO: 543 - DNA, 38 bp, Artificial Sequence
  Synthetic oligonucleotide
gcgtgttttatctctactgtgcgaacgtttggaattga

SEQ ID NO: 544 - DNA, 38 bp, Artificial Sequence
  Synthetic oligonucleotide
agctaggggtatctctactgtgcgattcttccgggtga

SEQ ID NO: 545 - DNA, 36 bp, Artificial Sequence
  Synthetic oligonucleotide
cgtgcccgctttattctccctggcttattggtccca

SEQ ID NO: 546 - DNA, 38 bp, Artificial Sequence
  Synthetic oligonucleotide
gatgcgccgctttacactcttgttcttacccgctttga

SEQ ID NO: 547 - DNA, 35 bp, Artificial Sequence
  Synthetic oligonucleotide
ggggcatgtaccaaccgttatttactctactgtgc

SEQ ID NO: 548 - DNA, 35 bp, Artificial Sequence
  Synthetic oligonucleotide
gcatcgtgtccatgcccaaatggttcgtcttttta

SEQ ID NO: 549 - DNA, 38 bp, Artificial Sequence
  Synthetic oligonucleotide
atgcactggacgcgcatgtcgtttcatttctccattga

SEQ ID NO: 550 - DNA, 34 bp, Artificial Sequence
  Synthetic oligonucleotide
aagcacgggctgcattcgattcaggtaaacaatt

SEQ ID NO: 551 - DNA, 37 bp, Artificial Sequence
  Synthetic oligonucleotide
acacccgcatgaggtatcctgtggatcgtgggacgga

SEQ ID NO: 552 - DNA, 35 bp, Artificial Sequence
  Synthetic oligonucleotide
gccagctttcgttcatataccactatcgctttgta

SEQ ID NO: 553 - DNA, 38 bp, Artificial Sequence
  Synthetic oligonucleotide
acagtcataacagactccgctgcgtgctaagcggatga

SEQ ID NO: 554 - DNA, 36 bp, Artificial Sequence
  Synthetic oligonucleotide
gcgcgctaacgggtatctgcaggtcctactagttta

SEQ ID NO: 555 - DNA, 35 bp, Artificial Sequence
  Synthetic oligonucleotide
atgcacctgtctgtcagtccccgctaggccatatt

SEQ ID NO: 556 - DNA, 38 bp, Artificial Sequence
  Synthetic oligonucleotide
ccatgcgcccggttgagatttaacggatctcgctttga

SEQ ID NO: 557 - DNA, 35 bp, Artificial Sequence
  Synthetic oligonucleotide
gcacacctcgctttaacacttgtaactacgcttca

SEQ ID NO: 558 - DNA, 35 bp, Artificial Sequence
  Synthetic oligonucleotide
tcacctactaaggactgatagctgcctacattgtt

SEQ ID NO: 559 - DNA, 36 bp, Artificial Sequence
  Synthetic oligonucleotide
ccacgagtctaggggcgtaacgcagtaaggcataca

SEQ ID NO: 560 - DNA, 38 bp, Artificial Sequence
  Synthetic oligonucleotide
acatgcgtgctaaggtactactggtgtcgaacctttga

SEQ ID NO: 561 - DNA, 35 bp, Artificial Sequence
  Synthetic oligonucleotide
atcgtagtacatacagtgcgtttcgtaaattgcct

SEQ ID NO: 562 - DNA, 35 bp, Artificial Sequence
  Synthetic oligonucleotide
gcgccccgactgccactagcttttaattctcgctt

SEQ ID NO: 563 - DNA, 36 bp, Artificial Sequence
  Synthetic oligonucleotide
tgctagctggcccatactcaactgtgcgttactcaa

SEQ ID NO: 564 - DNA, 35 bp, Artificial Sequence
  Synthetic oligonucleotide
actctgcatccttcaactctactgtgcggttattt

SEQ ID NO: 565 - DNA, 38 bp, Artificial Sequence
  Synthetic oligonucleotide
gctaactgcagggcacacaatctcttaaggcttaatga

SEQ ID NO: 566 - DNA, 35 bp, Artificial Sequence
  Synthetic oligonucleotide
gcgtgggcctggtctttactactaaacaaattggt

SEQ ID NO: 567 - DNA, 35 bp, Artificial Sequence
  Synthetic oligonucleotide
gatcgtaacgcactgagggtcaggcattacccgcc

SEQ ID NO: 568 - DNA, 37 bp, Artificial Sequence
  Synthetic oligonucleotide
gcccggggctaggggaaagaacctgccggtcatggga

SEQ ID NO: 569 - DNA, 35 bp, Artificial Sequence
  Synthetic oligonucleotide
gcgacctagggtaacgatcgtagttcacccataat

SEQ ID NO: 570 - DNA, 36 bp, Artificial Sequence
  Synthetic oligonucleotide
ttacctaccacagtctccgcctcgttatccttatca

SEQ ID NO: 571 - DNA, 36 bp, Artificial Sequence
  Synthetic oligonucleotide
gccgcgtgcctggccgtggtgcatcactaagttgaa

SEQ ID NO: 572 - DNA, 35 bp, Artificial Sequence
  Synthetic oligonucleotide
ggcgcgcgctagccatacgaactgcttgaacattt

SEQ ID NO: 573 - DNA, 37 bp, Artificial Sequence
  Synthetic oligonucleotide
tgcgaatcgtagccatcgtccactgctgatttgcgga

SEQ ID NO: 574 - DNA, 36 bp, Artificial Sequence
  Synthetic oligonucleotide
gcgaccgattcttctctcaaacgcttacttctatga

SEQ ID NO: 575 - DNA, 35 bp, Artificial Sequence
  Synthetic oligonucleotide
gccaaatgatctccactgtgcgaaatgggcttttt

SEQ ID NO: 576 - DNA, 38 bp, Artificial Sequence
  Synthetic oligonucleotide
tgagcacacaatggacgtgacaccaatctttcttatga

SEQ ID NO: 577 - DNA, 36 bp, Artificial Sequence
  Synthetic oligonucleotide
tcatcacgcgctagtgaacgtgttgtagcaccccta

SEQ ID NO: 578 - DNA, 36 bp, Artificial Sequence
  Synthetic oligonucleotide
tcatgtgcgtgccaactgacgaggtgcaggctagcc

SEQ ID NO: 579 - DNA, 38 bp, Artificial Sequence
  Synthetic oligonucleotide
atcgtagctgctgcagtcccctgtcttaatatccctga

SEQ ID NO: 580 - DNA, 36 bp, Artificial Sequence
  Synthetic oligonucleotide
cgtatcgtagacgttacggaaggagataatgcgcaa

SEQ ID NO: 581 - DNA, 36 bp, Artificial Sequence
  Synthetic oligonucleotide
cttgccagctttccttgtcttcgctttcattacata

SEQ ID NO: 582 - DNA, 38 bp, Artificial Sequence
  Synthetic oligonucleotide
gctgtcattgaatctctactgtgcgatccactttttga

SEQ ID NO: 583 - DNA, 38 bp, Artificial Sequence
  Synthetic oligonucleotide
catgcgccagcttcttctgattttatctatctctatga

SEQ ID NO: 584 - DNA, 36 bp, Artificial Sequence
  Synthetic oligonucleotide
ccatgcccgcttaagcttcttttctatgtttctacg

SEQ ID NO: 585 - DNA, 35 bp, Artificial Sequence
  Synthetic oligonucleotide
tagcaggagtaccctccaccgtgcacattgtttcc

SEQ ID NO: 586 - DNA, 37 bp, Artificial Sequence
  Synthetic oligonucleotide
catgcccgctttgtttctccgctttttggtattccga

SEQ ID NO: 587 - DNA, 36 bp, Artificial Sequence
  Synthetic oligonucleotide
atgcacgtcgaaaggcatgcggtacaactcctatga

SEQ ID NO: 588 - DNA, 35 bp, Artificial Sequence
  Synthetic oligonucleotide
agacagcaggcatagcggggaacctctaccgtgcc

SEQ ID NO: 589 - DNA, 35 bp, Artificial Sequence
  Synthetic oligonucleotide
aagtaacgcgggttacaactttttctccaccgtgc

SEQ ID NO: 590 - DNA, 36 bp, Artificial Sequence
  Synthetic oligonucleotide
acagtctcatgcccgcttttaatcataccgcttaca

SEQ ID NO: 591 - DNA, 38 bp, Artificial Sequence
  Synthetic oligonucleotide
gcgcccgaccattccctaagcttttgaccccactatga

SEQ ID NO: 592 - DNA, 37 bp, Artificial Sequence
  Synthetic oligonucleotide
gcgacgactatcgcttgttcttgaatacctcgcttta

SEQ ID NO: 593 - DNA, 34 bp, Artificial Sequence
  Synthetic oligonucleotide
aaactctactgtgcctcagtttcaaaccggttct

SEQ ID NO: 594 - DNA, 35 bp, Artificial Sequence
  Synthetic oligonucleotide
gtcgtagtactgcgaaatgggccatgcgcaaactt

SEQ ID NO: 595 - DNA, 35 bp, Artificial Sequence
  Synthetic oligonucleotide
cgtgcggatttctccaccgtgcttttgacctctga

SEQ ID NO: 596 - DNA, 38 bp, Artificial Sequence
  Synthetic oligonucleotide
gactgcgacctacacttatttgctctactgtgccttga

SEQ ID NO: 597 - DNA, 35 bp, Artificial Sequence
  Synthetic oligonucleotide
catgcggcttctaccaggtcaaactagccccaatt

SEQ ID NO: 598 - DNA, 36 bp, Artificial Sequence
  Synthetic oligonucleotide
aaccggagctaggtacgtgtctgtcaggcatgaaga

SEQ ID NO: 599 - DNA, 36 bp, Artificial Sequence
  Synthetic oligonucleotide
atgagtccgcgtgcctggacctttacccccgacgaa

SEQ ID NO: 600 - DNA, 38 bp, Artificial Sequence
  Synthetic oligonucleotide
catgccgtacgcttattggatacaccatcgctttttga

SEQ ID NO: 601 - DNA, 37 bp, Artificial Sequence
  Synthetic oligonucleotide
gcgttggtgttcctctctactgtgcctgattttttga

SEQ ID NO: 602 - DNA, 37 bp, Artificial Sequence
  Synthetic oligonucleotide
atcgtagtactgcacgggtgccacgtgtcttcccaga

SEQ ID NO: 603 - DNA, 35 bp, Artificial Sequence
  Synthetic oligonucleotide
aggcacgtacaggcatcgaccgctttcttctttcc

SEQ ID NO: 604 - DNA, 36 bp, Artificial Sequence
  Synthetic oligonucleotide
gccatgcgggataatattaaatcctctaccgtgcca

SEQ ID NO: 605 - DNA, 37 bp, Artificial Sequence
  Synthetic oligonucleotide
tctgccatgcggctcattccgaaactctactgtgcga

SEQ ID NO: 606 - DNA, 35 bp, Artificial Sequence
  Synthetic oligonucleotide
ttttgcgattcctctactgtgccttctggttttgt

SEQ ID NO: 607 - DNA, 35 bp, Artificial Sequence
  Synthetic oligonucleotide
ctgcagcaatcatgcaggctttcatcgctttcatc

SEQ ID NO: 608 - DNA, 35 bp, Artificial Sequence
  Synthetic oligonucleotide
tcacctaccaagatctctcgcgccctatagtttct

SEQ ID NO: 609 - DNA, 35 bp, Artificial Sequence
  Synthetic oligonucleotide
caccgcgtgccaggggatcggaatgatatcaactg

SEQ ID NO: 610 - DNA, 36 bp, Artificial Sequence
  Synthetic oligonucleotide
taaactaccaagggcatgccaccatctactacatga

SEQ ID NO: 611 - DNA, 35 bp, Artificial Sequence
  Synthetic oligonucleotide
atcgtagtactgaaaagcgggatccagttctaatt

SEQ ID NO: 612 - DNA, 35 bp, Artificial Sequence
  Synthetic oligonucleotide
gaaggcaagcacccccctgctcaactagccaacaa

SEQ ID NO: 613 - DNA, 38 bp, Artificial Sequence
  Synthetic oligonucleotide
ctgccctcgttctccaccgtgcccactttgtaaactga

SEQ ID NO: 614 - DNA, 36 bp, Artificial Sequence
  Synthetic oligonucleotide
gatgcaagggcccgttagtactggggtctaattaaa

SEQ ID NO: 615 - DNA, 38 bp, Artificial Sequence
  Synthetic oligonucleotide
catgcgatggtcttgcacttggttagtaatctccttga

SEQ ID NO: 616 - DNA, 35 bp, Artificial Sequence
  Synthetic oligonucleotide
gtgcgcgctaacacggagagtctcaacttaacctg

SEQ ID NO: 617 - DNA, 36 bp, Artificial Sequence
  Synthetic oligonucleotide
aacaaattgccgtggggacgtggtcatgcggattta

SEQ ID NO: 618 - DNA, 36 bp, Artificial Sequence
  Synthetic oligonucleotide
gcgtggcacgaagctttctatttttacttgattcca

SEQ ID NO: 619 - DNA, 35 bp, Artificial Sequence
  Synthetic oligonucleotide
caatgccagcttacgtttatatcccaattcgcttt

SEQ ID NO: 620 - DNA, 35 bp, Artificial Sequence
  Synthetic oligonucleotide
aacggtcatgccagcttttggtacttagttctcct

SEQ ID NO: 621 - DNA, 37 bp, Artificial Sequence
  Synthetic oligonucleotide
gaacgcaggcatccgcattagctttttccttctatga

SEQ ID NO: 622 - DNA, 36 bp, Artificial Sequence
  Synthetic oligonucleotide
gcgccccgtacagcatcgtgtcatggacctacccta

SEQ ID NO: 623 - DNA, 37 bp, Artificial Sequence
  Synthetic oligonucleotide
tcgtagtaactgcaggatccactccactctcatttga

SEQ ID NO: 624 - DNA, 35 bp, Artificial Sequence
  Synthetic oligonucleotide
atgcactgtacgagcgggatcgctagtttacaaca

SEQ ID NO: 625 - DNA, 35 bp, Artificial Sequence
  Synthetic oligonucleotide
gcgcgctaacgtcactgcacatccagggccctatc

SEQ ID NO: 626 - DNA, 38 bp, Artificial Sequence
  Synthetic oligonucleotide
acccgatcgtagggaacgtaccgataacaaaattatga

SEQ ID NO: 627 - DNA, 36 bp, Artificial Sequence
  Synthetic oligonucleotide
actggtaggcatcgacctcaagctttctcaacatca

SEQ ID NO: 628 - DNA, 35 bp, Artificial Sequence
  Synthetic oligonucleotide
acacctaccaggtcacgcgttcgaacttcacttaa

SEQ ID NO: 629 - DNA, 35 bp, Artificial Sequence
  Synthetic oligonucleotide
accgcgcgctagggacgggatgcttcggcctgtta

SEQ ID NO: 630 - DNA, 35 bp, Artificial Sequence
  Synthetic oligonucleotide
taagcaactagggtgctgtcatcgcgatctctttt

SEQ ID NO: 631 - DNA, 35 bp, Artificial Sequence
  Synthetic oligonucleotide
atcccgggactagggcgacgtgatgcatctctcat

SEQ ID NO: 632 - DNA, 35 bp, Artificial Sequence
  Synthetic oligonucleotide
gacaaggtctgcccgcttcccacactacgcttaca

SEQ ID NO: 633 - DNA, 36 bp, Artificial Sequence
  Synthetic oligonucleotide
gcgcccgcttctcataactatggctttattctcaca

SEQ ID NO: 634 - DNA, 36 bp, Artificial Sequence
  Synthetic oligonucleotide
tgctccgggcctaggagattctacgtacgcaatgca

SEQ ID NO: 635 - DNA, 36 bp, Artificial Sequence
  Synthetic oligonucleotide
gccagactcgccccctatttttttggaactcgccta

SEQ ID NO: 636 - DNA, 38 bp, Artificial Sequence
  Synthetic oligonucleotide
gcatccgttaaactcgcctctcaaatcgaatcccatga

SEQ ID NO: 637 - DNA, 35 bp, Artificial Sequence
  Synthetic oligonucleotide
ctcgcagcatgcgaaggctttactcacaactatcg

SEQ ID NO: 638 - DNA, 37 bp, Artificial Sequence
  Synthetic oligonucleotide
ccgtgcgaacgttatgcgaccatgcgctctctcttga

SEQ ID NO: 639 - DNA, 38 bp, Artificial Sequence
  Synthetic oligonucleotide
gtctagccgcttttgttatgatattcttctctttatga

SEQ ID NO: 640 - DNA, 36 bp, Artificial Sequence
  Synthetic oligonucleotide
gcgtgccaacgtaccttccttatctggtgaactaca

SEQ ID NO: 641 - DNA, 35 bp, Artificial Sequence
  Synthetic oligonucleotide
gtgcgcgctaacactcctctcggtcatttgctgga

SEQ ID NO: 642 - DNA, 35 bp, Artificial Sequence
  Synthetic oligonucleotide
agcgcgtgattgcacgtgactgcacttctaatctt

SEQ ID NO: 643 - DNA, 35 bp, Artificial Sequence
  Synthetic oligonucleotide
tccgaacctaggaagccggatggaacatgcgccca

SEQ ID NO: 644 - DNA, 35 bp, Artificial Sequence
  Synthetic oligonucleotide
catcgcaagctttaatacaaaccctatccattgct

SEQ ID NO: 645 - DNA, 36 bp, Artificial Sequence
  Synthetic oligonucleotide
actgcgtgccgagtacaggactacagttaatggcaa

SEQ ID NO: 646 - DNA, 35 bp, Artificial Sequence
  Synthetic oligonucleotide
ccatgcgtgcctatggacgtccccaaacattgtct

SEQ ID NO: 647 - DNA, 35 bp, Artificial Sequence
  Synthetic oligonucleotide
tatcgcgggcaggcgattcgcttgtatttaatccg

SEQ ID NO: 648 - DNA, 36 bp, Artificial Sequence
  Synthetic oligonucleotide
actgcaccgtgtcatggcgagagctcacctaattca

SEQ ID NO: 649 - DNA, 35 bp, Artificial Sequence
  Synthetic oligonucleotide
gacatgcaaaggcccttaattgactccactgtgcc

SEQ ID NO: 650 - DNA, 35 bp, Artificial Sequence
  Synthetic oligonucleotide
catttgcgtgcctaaatgcggcgcgggctggcgac

SEQ ID NO: 651 - DNA, 35 bp, Artificial Sequence
  Synthetic oligonucleotide
gctggccaatgtatctcaaccgtgccgaaattatt

SEQ ID NO: 652 - DNA, 35 bp, Artificial Sequence
  Synthetic oligonucleotide
tgctaggactagccggttttctattactctatttt

SEQ ID NO: 653 - DNA, 36 bp, Artificial Sequence
  Synthetic oligonucleotide
tccggagctaggaactacggcgatctctgcgcctaa

SEQ ID NO: 654 - DNA, 35 bp, Artificial Sequence
  Synthetic oligonucleotide
gcctagtggacaccccgattcgaccttttttgctt

SEQ ID NO: 655 - DNA, 36 bp, Artificial Sequence
  Synthetic oligonucleotide
agtggaccaacggatcgcgtgccaggccgatgggca

SEQ ID NO: 656 - DNA, 36 bp, Artificial Sequence
  Synthetic oligonucleotide
gataaccagtgtcatgcaaacactatacattcctta

SEQ ID NO: 657 - DNA, 35 bp, Artificial Sequence
  Synthetic oligonucleotide
actgcacaacattgattctgacaggttgacaccaa

SEQ ID NO: 658 - DNA, 38 bp, Artificial Sequence
  Synthetic oligonucleotide
agtgcgcaatagtgcgacaagcttctatccatttttga

SEQ ID NO: 659 - DNA, 36 bp, Artificial Sequence
  Synthetic oligonucleotide
gctgacgttcgtagtccatgtacgggctgtcatcaa

SEQ ID NO: 660 - DNA, 36 bp, Artificial Sequence
  Synthetic oligonucleotide
tcgtgcagtatcgcggtcatgtcacactcccgtaca

SEQ ID NO: 661 - DNA, 36 bp, Artificial Sequence
  Synthetic oligonucleotide
agcacgatcgtagtgcgaatcgaacggggtctgcga

SEQ ID NO: 662 - DNA, 36 bp, Artificial Sequence
  Synthetic oligonucleotide
gcgcgctaacgactgtaggaatccaattctgaccga

SEQ ID NO: 663 - DNA, 38 bp, Artificial Sequence
  Synthetic oligonucleotide
agtgactgcgggcactgcgatcgcttttgattatttga

SEQ ID NO: 664 - DNA, 36 bp, Artificial Sequence
  Synthetic oligonucleotide
agccacccatcctcaaccgtgccataatcgcctcta

SEQ ID NO: 665 - DNA, 35 bp, Artificial Sequence
  Synthetic oligonucleotide
gcctctaccgtgcctgtgacccaccagttttttat

SEQ ID NO: 666 - DNA, 35 bp, Artificial Sequence
  Synthetic oligonucleotide
tcgtagtacgcaggtggtcaagcacgatttcttta

SEQ ID NO: 667 - DNA, 38 bp, Artificial Sequence
  Synthetic oligonucleotide
tcagtacgcactagtacattgccaagctttccacatga

SEQ ID NO: 668 - DNA, 35 bp, Artificial Sequence
  Synthetic oligonucleotide
aagcggaactagccaaggcaagggaaatgccctca

SEQ ID NO: 669 - DNA, 35 bp, Artificial Sequence
  Synthetic oligonucleotide
ggaccgaatctaggctgtactgtgcacgcatcgcc

SEQ ID NO: 670 - DNA, 35 bp, Artificial Sequence
  Synthetic oligonucleotide
ttacctacctggtcaggcataacatttagttcctc

SEQ ID NO: 671 - DNA, 38 bp, Artificial Sequence
  Synthetic oligonucleotide
aagaccgcgtgccaggtcaacgtacgcacatgcaatga

SEQ ID NO: 672 - DNA, 38 bp, Artificial Sequence
  Synthetic oligonucleotide
atcgtagtactgtagggcctctgtttcactcaatatga

SEQ ID NO: 673 - DNA, 35 bp, Artificial Sequence
  Synthetic oligonucleotide
aggacaggcgggttttgctgacgttgtctatactg

SEQ ID NO: 674 - DNA, 35 bp, Artificial Sequence
  Synthetic oligonucleotide
tactccactgtgcatccgatcttcttccccaactc

SEQ ID NO: 675 - DNA, 37 bp, Artificial Sequence
  Synthetic oligonucleotide
tctccactgtgcccgtaacttttcttttactgtccga

SEQ ID NO: 676 - DNA, 36 bp, Artificial Sequence
  Synthetic oligonucleotide
ccgggcctaggaggactgcatgacccctttaaccaa

SEQ ID NO: 677 - DNA, 35 bp, Artificial Sequence
  Synthetic oligonucleotide
ccgggcctaggacggttccacagtcagcgaatcct

SEQ ID NO: 678 - DNA, 35 bp, Artificial Sequence
  Synthetic oligonucleotide
aacgcgcgcttgggatgtatgcatcatctagattt

SEQ ID NO: 679 - DNA, 35 bp, Artificial Sequence
  Synthetic oligonucleotide
cacgacgcaccttaccgctttctatttttccgctt

SEQ ID NO: 680 - DNA, 35 bp, Artificial Sequence
  Synthetic oligonucleotide
gcacttggccgctttaactactacgctttgtcctc

SEQ ID NO: 681 - DNA, 37 bp, Artificial Sequence
  Synthetic oligonucleotide
cgtgtacgccagtgccgtgcagtcaggcgatctatga

SEQ ID NO: 682 - DNA, 36 bp, Artificial Sequence
  Synthetic oligonucleotide
cttaggcaatgacgtgcccttatgcgacttcgccca

SEQ ID NO: 683 - DNA, 38 bp, Artificial Sequence
  Synthetic oligonucleotide
gcaccgtttccaccgcgcgtggatcttcccaactttga

SEQ ID NO: 684 - DNA, 35 bp, Artificial Sequence
  Synthetic oligonucleotide
gcggacctagcttacggactgtaattaacgttttt

SEQ ID NO: 685 - DNA, 38 bp, Artificial Sequence
  Synthetic oligonucleotide
atgcgcatcccctctaccgtgcaattttccatccctga

SEQ ID NO: 686 - DNA, 36 bp, Artificial Sequence
  Synthetic oligonucleotide
gacgcgcgccagacagggaactgcacaggcatgcca

SEQ ID NO: 687 - DNA, 35 bp, Artificial Sequence
  Synthetic oligonucleotide
ccgagactaggacccctgtgttcatgcgctatttc

SEQ ID NO: 688 - DNA, 35 bp, Artificial Sequence
  Synthetic oligonucleotide
gctaactgcaggcacagcctaagaaacctcatgta

SEQ ID NO: 689 - DNA, 38 bp, Artificial Sequence
  Synthetic oligonucleotide
tgcagtctagcccgcttaatgtattccttgattcttga

SEQ ID NO: 690 - DNA, 35 bp, Artificial Sequence
  Synthetic oligonucleotide
gcgtgctagcgtactgcatggatactttggtagct

SEQ ID NO: 691 - DNA, 38 bp, Artificial Sequence
  Synthetic oligonucleotide
tcgtagtacagcagaccctccctacctacaattggtga

SEQ ID NO: 692 - DNA, 35 bp, Artificial Sequence
  Synthetic oligonucleotide
gccgctgactgagttctctctactgtgcgtatttt

SEQ ID NO: 693 - DNA, 36 bp, Artificial Sequence
  Synthetic oligonucleotide
gccagcagccctgaactcctctgaagcatcgccgca

SEQ ID NO: 694 - DNA, 35 bp, Artificial Sequence
  Synthetic oligonucleotide
taggtctgcacatgcgctaggcttttcttaccctg

SEQ ID NO: 695 - DNA, 38 bp, Artificial Sequence
  Synthetic oligonucleotide
gcgacgccccacgctttgacctaaacccatcaatatga

SEQ ID NO: 696 - DNA, 38 bp, Artificial Sequence
  Synthetic oligonucleotide
cgctacagacatgcgcatcttgacttatattcaattga

SEQ ID NO: 697 - DNA, 35 bp, Artificial Sequence
  Synthetic oligonucleotide
atgcactactgcgagcgagcacaggtttcctcctt

SEQ ID NO: 698 - DNA, 38 bp, Artificial Sequence
  Synthetic oligonucleotide
aacgcgtgccagagaagaaccgcggtctcgccccatga

SEQ ID NO: 699 - DNA, 35 bp, Artificial Sequence
  Synthetic oligonucleotide
cattgcgaactagctttcttctccttctagctttt

SEQ ID NO: 700 - DNA, 35 bp, Artificial Sequence
  Synthetic oligonucleotide
catgccctagaacattgctttaacactttcgcttt

SEQ ID NO: 701 - DNA, 38 bp, Artificial Sequence
  Synthetic oligonucleotide
tcatgcgatcaatcgctctgcgtgcctagatcgattga

SEQ ID NO: 702 - DNA, 34 bp, Artificial Sequence
  Synthetic oligonucleotide
gcgaccgtggcttcctacctccaagctttccgac

SEQ ID NO: 703 - DNA, 36 bp, Artificial Sequence
  Synthetic oligonucleotide
gcgtgctaacgtactagaccaaagcgagtaacatca

SEQ ID NO: 704 - DNA, 37 bp, Artificial Sequence
  Synthetic oligonucleotide
tcacgcgcgcttgggattacgtacaatcatcaatgga

SEQ ID NO: 705 - DNA, 36 bp, Artificial Sequence
  Synthetic oligonucleotide
gcactacaccctattcccgcgtaggtccccgagcct

SEQ ID NO: 706 - DNA, 36 bp, Artificial Sequence
  Synthetic oligonucleotide
taactccactgtgcgatcattgtttttcttttttga

SEQ ID NO: 707 - DNA, 35 bp, Artificial Sequence
  Synthetic oligonucleotide
atcgtagtactggtactcctgccctatttcgataa

SEQ ID NO: 708 - DNA, 35 bp, Artificial Sequence
  Synthetic oligonucleotide
acactctgcagcctagaactctaccgtgctaattt

SEQ ID NO: 709 - DNA, 35 bp, Artificial Sequence
  Synthetic oligonucleotide
gtgcgcgcgctagcatgcgtaatcatgtcatttaa

SEQ ID NO: 710 - DNA, 35 bp, Artificial Sequence
  Synthetic oligonucleotide
tcaatctcaactgtgcttccctggtttttagtttc

SEQ ID NO: 711 - DNA, 38 bp, Artificial Sequence
  Synthetic oligonucleotide
gtcctgcgtgctaaggaccctaagcttcatgcgtatga

SEQ ID NO: 712 - DNA, 36 bp, Artificial Sequence
  Synthetic oligonucleotide
tcgccgcccaaggatccctctactgtgccactttaa

SEQ ID NO: 713 - DNA, 35 bp, Artificial Sequence
  Synthetic oligonucleotide
gcgtgcctacgtaacgttcatgcggatggaccgat

SEQ ID NO: 714 - DNA, 35 bp, Artificial Sequence
  Synthetic oligonucleotide
cgtgccttggccggaccagtccttttgatcactac

SEQ ID NO: 715 - DNA, 35 bp, Artificial Sequence
  Synthetic oligonucleotide
caggcatgacgatttggcttaacttcccttgctta

SEQ ID NO: 716 - DNA, 35 bp, Artificial Sequence
  Synthetic oligonucleotide
tatgcgtatccaatcgcttttcaattcctatgctt

SEQ ID NO: 717 - DNA, 35 bp, Artificial Sequence
  Synthetic oligonucleotide
ccgcgtgccaggcgtaatgtaggcaggccctttat

SEQ ID NO: 718 - DNA, 35 bp, Artificial Sequence
  Synthetic oligonucleotide
gctaacagcagtcattgaatcctgtacgctccaaa

SEQ ID NO: 719 - DNA, 35 bp, Artificial Sequence
  Synthetic oligonucleotide
atcgcctgcgccaggactggggtgcagatcatgcg

SEQ ID NO: 720 - DNA, 37 bp, Artificial Sequence
  Synthetic oligonucleotide
ctgagcagtcaccattctttatctctactgtgctcga

SEQ ID NO: 721 - DNA, 35 bp, Artificial Sequence
  Synthetic oligonucleotide
acccacatcctgcgtgctaaggacggtggggccgg

SEQ ID NO: 722 - DNA, 36 bp, Artificial Sequence
  Synthetic oligonucleotide
ccggacctaggaatcgactcaggcgtggtagaacaa

SEQ ID NO: 723 - DNA, 35 bp, Artificial Sequence
  Synthetic oligonucleotide
tcatggccactaaactcgccccataaaaccttgtc

SEQ ID NO: 724 - DNA, 35 bp, Artificial Sequence
  Synthetic oligonucleotide
gactctactgtgcccgtttgttgttcttcccgaac

SEQ ID NO: 725 - DNA, 36 bp, Artificial Sequence
  Synthetic oligonucleotide
ggagccgggcctgccacgtagctcggaaaatgcgga

SEQ ID NO: 726 - DNA, 37 bp, Artificial Sequence
  Synthetic oligonucleotide
gatttcactagctctctactgtgcccatttctgttga

SEQ ID NO: 727 - DNA, 35 bp, Artificial Sequence
  Synthetic oligonucleotide
agcggatctagccagtatgcactcatgtcactttt

SEQ ID NO: 728 - DNA, 35 bp, Artificial Sequence
  Synthetic oligonucleotide
actgcacgtgcgcgcttaagttttcgcttctcttt

SEQ ID NO: 729 - DNA, 38 bp, Artificial Sequence
  Synthetic oligonucleotide
gtcgaggggaactcctctgaggctcaacacatatctga

SEQ ID NO: 730 - DNA, 35 bp, Artificial Sequence
  Synthetic oligonucleotide
gcgatccggttaaactacacactctactgtgcgaa

SEQ ID NO: 731 - DNA, 35 bp, Artificial Sequence
  Synthetic oligonucleotide
gctaaccaaggaatgcgctgccttagacagaattg

SEQ ID NO: 732 - DNA, 35 bp, Artificial Sequence
  Synthetic oligonucleotide
tcacctaccagggcgtggtaggtttttctctctac

SEQ ID NO: 733 - DNA, 37 bp, Artificial Sequence
  Synthetic oligonucleotide
cctcgcgtgccagggacctagtgcaatctatccgaga

SEQ ID NO: 734 - DNA, 38 bp, Artificial Sequence
  Synthetic oligonucleotide
ccgagcgaacgtacggaaagtgcgtactttatctttga

SEQ ID NO: 735 - DNA, 36 bp, Artificial Sequence
  Synthetic oligonucleotide
agtacgtgaccactactttccctcctttgtacttga

SEQ ID NO: 736 - DNA, 38 bp, Artificial Sequence
  Synthetic oligonucleotide
tcatgcggttgattggtctactcatgtttcttaattga

SEQ ID NO: 737 - DNA, 36 bp, Artificial Sequence
  Synthetic oligonucleotide
gcacaatcccacgcttcctattataccacgattcta

SEQ ID NO: 738 - DNA, 35 bp, Artificial Sequence
  Synthetic oligonucleotide
acaacccggcgcgccacggggtgatcgacaactgt

SEQ ID NO: 739 - DNA, 35 bp, Artificial Sequence
  Synthetic oligonucleotide
gatcgtccgcgtgcctggcaacgatacccgacaag

SEQ ID NO: 740 - DNA, 35 bp, Artificial Sequence
  Synthetic oligonucleotide
gcgtgtctctctactgtgcgcctcattcttatata

SEQ ID NO: 741 - DNA, 35 bp, Artificial Sequence
  Synthetic oligonucleotide
tcgtagtacacgcagtcgacaaacaagctagtatt

SEQ ID NO: 742 - DNA, 36 bp, Artificial Sequence
  Synthetic oligonucleotide
ttacctaccaacgtaatgcgctacaaccagagagta

SEQ ID NO: 743 - DNA, 35 bp, Artificial Sequence
  Synthetic oligonucleotide
ttagcgaaactagcgtacgacaaggtccaatgtaa

SEQ ID NO: 744 - DNA, 36 bp, Artificial Sequence
  Synthetic oligonucleotide
tgggcggatctagcaaaaacggacgcctcctgcgaa

SEQ ID NO: 745 - DNA, 35 bp, Artificial Sequence
  Synthetic oligonucleotide
aagcacgggacgcatgtcgtggctacctgaattct

SEQ ID NO: 746 - DNA, 38 bp, Artificial Sequence
  Synthetic oligonucleotide
gtgtgcaggcatgacgataagctttctaactcctatga

SEQ ID NO: 747 - DNA, 35 bp, Artificial Sequence
  Synthetic oligonucleotide
tctgcgcgcctagaagtacgcaatcaccacgcgac

SEQ ID NO: 748 - DNA, 38 bp, Artificial Sequence
  Synthetic oligonucleotide
atgtcgctgcaggtgcgtgcaagctttaatctccttga

SEQ ID NO: 749 - DNA, 37 bp, Artificial Sequence
  Synthetic oligonucleotide
tccgggcctaggaacggtcactagggaatgcccctga

SEQ ID NO: 750 - DNA, 36 bp, Artificial Sequence
  Synthetic oligonucleotide
acgtagtgcacatcctagactccactgtgcctctta

SEQ ID NO: 751 - DNA, 35 bp, Artificial Sequence
  Synthetic oligonucleotide
tcatgcataggcttatatgacaccatcgcttcttt

SEQ ID NO: 752 - DNA, 36 bp, Artificial Sequence
  Synthetic oligonucleotide
actgccggctgcaagcttttaggtacacttgattca

SEQ ID NO: 753 - DNA, 38 bp, Artificial Sequence
  Synthetic oligonucleotide
cacgcgccgctttttcgcctatacgctttttattttga

SEQ ID NO: 754 - DNA, 37 bp, Artificial Sequence
  Synthetic oligonucleotide
tctgactgcacgcatgggaccgcttaccactaaccga

SEQ ID NO: 755 - DNA, 36 bp, Artificial Sequence
  Synthetic oligonucleotide
tgcgggactagcataagttccacatgcgaagacaaa

SEQ ID NO: 756 - DNA, 35 bp, Artificial Sequence
  Synthetic oligonucleotide
gcgtgcctacgtacaggcggatatgcgcgtttccc

SEQ ID NO: 757 - DNA, 38 bp, Artificial Sequence
  Synthetic oligonucleotide
gcagtcgcgtatcgattcgctttcttatctggttatga

SEQ ID NO: 758 - DNA, 38 bp, Artificial Sequence
  Synthetic oligonucleotide
cgcaggcatgcaggcttttagtttaattactcctttga

SEQ ID NO: 759 - DNA, 36 bp, Artificial Sequence
  Synthetic oligonucleotide
gacactccagcactaaagctagtgtggtatcactta

SEQ ID NO: 760 - DNA, 38 bp, Artificial Sequence
  Synthetic oligonucleotide
cactgcgcttctagtactacctccactgtgctttttga

SEQ ID NO: 761 - DNA, 35 bp, Artificial Sequence
  Synthetic oligonucleotide
acacatgccgcttaatattgattcgcttttatcat

SEQ ID NO: 762 - DNA, 35 bp, Artificial Sequence
  Synthetic oligonucleotide
gagtagccaaacgcgtgcttggtggcgatcacgta

SEQ ID NO: 763 - DNA, 35 bp, Artificial Sequence
  Synthetic oligonucleotide
tactaaggaaagcggtaaaacgtacactgaaatct

SEQ ID NO: 764 - DNA, 35 bp, Artificial Sequence
  Synthetic oligonucleotide
ggtggtgcgaaaaatgcggtgtgaactcccctgaa

SEQ ID NO: 765 - DNA, 35 bp, Artificial Sequence
  Synthetic oligonucleotide
tatcgcgagccaggagacgtaaaaaggaaatgcgg

SEQ ID NO: 766 - DNA, 35 bp, Artificial Sequence
  Synthetic oligonucleotide
ggccaccgaccactatgcatcgtgtcatgacgtaa

SEQ ID NO: 767 - DNA, 36 bp, Artificial Sequence
  Synthetic oligonucleotide
atccgatctctaccgtgcaacccacccctttgttta

SEQ ID NO: 768 - DNA, 37 bp, Artificial Sequence
  Synthetic oligonucleotide
gcggtcgatcctctcaactgtgcactttttactacga

SEQ ID NO: 769 - DNA, 37 bp, Artificial Sequence
  Synthetic oligonucleotide
attcgtagctcaactctactgtgcattttttgtttga

SEQ ID NO: 770 - DNA, 37 bp, Artificial Sequence
  Synthetic oligonucleotide
gccgctaaactgtctccactgtgctaccttatcttga

SEQ ID NO: 771 - DNA, 35 bp, Artificial Sequence
  Synthetic oligonucleotide
cgcgtgcttgcgtactgtccgcgtaatcacacaca

SEQ ID NO: 772 - DNA, 36 bp, Artificial Sequence
  Synthetic oligonucleotide
tctccactgtgccgtttcctccgttcttactcctaa

SEQ ID NO: 773 - DNA, 35 bp, Artificial Sequence
  Synthetic oligonucleotide
acctgcgtgctaaggaacgtagcattcgtgtgcga

SEQ ID NO: 774 - DNA, 35 bp, Artificial Sequence
  Synthetic oligonucleotide
acacgcgcgcttgggactgaactcagcaatgcacc

SEQ ID NO: 775 - DNA, 35 bp, Artificial Sequence
  Synthetic oligonucleotide
tcacctactaacgtgtgcggggtttttacatcact

SEQ ID NO: 776 - DNA, 36 bp, Artificial Sequence
  Synthetic oligonucleotide
gatagccgcttagccaacacaaccgcttttgattca

SEQ ID NO: 777 - DNA, 35 bp, Artificial Sequence
  Synthetic oligonucleotide
gcggccttgcatcgattcaactcgccctatttcaa

SEQ ID NO: 778 - DNA, 35 bp, Artificial Sequence
  Synthetic oligonucleotide
agcgcatcgtagccgtacagcaatgtaatattctc

SEQ ID NO: 779 - DNA, 35 bp, Artificial Sequence
  Synthetic oligonucleotide
gctaactgcaggccaccacgcttgccctggctacc

SEQ ID NO: 780 - DNA, 35 bp, Artificial Sequence
  Synthetic oligonucleotide
aagcactgtgccgcagatatgcgatttttgtgatt

SEQ ID NO: 781 - DNA, 38 bp, Artificial Sequence
  Synthetic oligonucleotide
tgagccgcgcgcctggccacgacgattcatgtgattga

SEQ ID NO: 782 - DNA, 37 bp, Artificial Sequence
  Synthetic oligonucleotide
catgcgtaagcttatgtttcgattacgttcccattga

SEQ ID NO: 783 - DNA, 35 bp, Artificial Sequence
  Synthetic oligonucleotide
gtggtccgcgcgaaccaccatgggtgcaggcgaat

SEQ ID NO: 784 - DNA, 35 bp, Artificial Sequence
  Synthetic oligonucleotide
tcacctaccagggaaatgtccagccaccccgagct

SEQ ID NO: 785 - DNA, 35 bp, Artificial Sequence
  Synthetic oligonucleotide
gcagggcttgcaggcttttaattgtttcactatcg

SEQ ID NO: 786 - DNA, 36 bp, Artificial Sequence
  Synthetic oligonucleotide
gctaagtgcggtcactgccccaggagcttgatgcta

SEQ ID NO: 787 - DNA, 35 bp, Artificial Sequence
  Synthetic oligonucleotide
gtgcgggactagcacgcagtacagctttctgcgtc

SEQ ID NO: 788 - DNA, 35 bp, Artificial Sequence
  Synthetic oligonucleotide
gcgggactagcgagtttagcctgatactacattga

SEQ ID NO: 789 - DNA, 37 bp, Artificial Sequence
  Synthetic oligonucleotide
gcggacgattcctgttcctttgcttatttctctgaga

SEQ ID NO: 790 - DNA, 35 bp, Artificial Sequence
  Synthetic oligonucleotide
acacggacctagggtcgtactgcaggaagttgttc

SEQ ID NO: 791 - DNA, 37 bp, Artificial Sequence
  Synthetic oligonucleotide
actccactgtgcctctttaacttctttccatatatga

SEQ ID NO: 792 - DNA, 35 bp, Artificial Sequence
  Synthetic oligonucleotide
gcgtgcctacgacgccaggcactagtttagtaaac

SEQ ID NO: 793 - DNA, 38 bp, Artificial Sequence
  Synthetic oligonucleotide
aagcggggagcaacgtactgccatttactattccatga

SEQ ID NO: 794 - DNA, 35 bp, Artificial Sequence
  Synthetic oligonucleotide
tttaacggaacgacctgtggctgcacgtttctcca

SEQ ID NO: 795 - DNA, 35 bp, Artificial Sequence
  Synthetic oligonucleotide
tttgtactgagcaagcgtacataccgaagccccgt

SEQ ID NO: 796 - DNA, 35 bp, Artificial Sequence
  Synthetic oligonucleotide
catgcgcgattagcttgttctaccaccgctttaca

SEQ ID NO: 797 - DNA, 38 bp, Artificial Sequence
  Synthetic oligonucleotide
catgtcgacctctttgtaaactcgccctattttcctga

SEQ ID NO: 798 - DNA, 35 bp, Artificial Sequence
  Synthetic oligonucleotide
cattgcgcgctttcaataacctccgcttataacac

SEQ ID NO: 799 - DNA, 35 bp, Artificial Sequence
  Synthetic oligonucleotide
catctagaggctcattcatattaacacgctttcct

SEQ ID NO: 800 - DNA, 37 bp, Artificial Sequence
  Synthetic oligonucleotide
tcgtagtgctgcaagtccttagtaccttggatcttga

SEQ ID NO: 801 - DNA, 35 bp, Artificial Sequence
  Synthetic oligonucleotide
atgcacggttctgctcaggccatcattttcttcac

SEQ ID NO: 802 - DNA, 35 bp, Artificial Sequence
  Synthetic oligonucleotide
gcgcgcctacgttaatgcacttcgtgacatcttcc

SEQ ID NO: 803 - DNA, 35 bp, Artificial Sequence
  Synthetic oligonucleotide
ccggtcgtagggtgactgcgggcataagctgggtt

SEQ ID NO: 804 - DNA, 35 bp, Artificial Sequence
  Synthetic oligonucleotide
tgcgcaggcccgttgtactcgctcactgctagatt

SEQ ID NO: 805 - DNA, 36 bp, Artificial Sequence
  Synthetic oligonucleotide
aagcacggacaagcatgtatgcgatcacgcccttta

SEQ ID NO: 806 - DNA, 35 bp, Artificial Sequence
  Synthetic oligonucleotide
gactgcgggactagcaacgtactgtggctggcgat

SEQ ID NO: 807 - DNA, 35 bp, Artificial Sequence
  Synthetic oligonucleotide
gcctccgtaacctacccgcgtgcctgggggttacc

SEQ ID NO: 808 - DNA, 35 bp, Artificial Sequence
  Synthetic oligonucleotide
gcagggaatccagcgaccgttcctctaccgtgcct

SEQ ID NO: 809 - DNA, 38 bp, Artificial Sequence
  Synthetic oligonucleotide
catgcggaagctttctctgttgatgatgaaccctttga

SEQ ID NO: 810 - DNA, 35 bp, Artificial Sequence
  Synthetic oligonucleotide
actgcgctaatgcccgcttaacctccatgattgtt

SEQ ID NO: 811 - DNA, 35 bp, Artificial Sequence
  Synthetic oligonucleotide
ggggtcgcgtgccagaccacgactcatgtctgtgc

SEQ ID NO: 812 - DNA, 35 bp, Artificial Sequence
  Synthetic oligonucleotide
atcgtagaactgcagacccgcatggctacctttgt

SEQ ID NO: 813 - DNA, 36 bp, Artificial Sequence
  Synthetic oligonucleotide
attgcggatcgtagctctaactgcgcatgcggtaca

SEQ ID NO: 814 - DNA, 35 bp, Artificial Sequence
  Synthetic oligonucleotide
tacacaccgctttactatcctcaatttcgctttcc

SEQ ID NO: 815 - DNA, 35 bp, Artificial Sequence
  Synthetic oligonucleotide
tgcctctactgtgccgataccggtttctttatatt

SEQ ID NO: 816 - DNA, 36 bp, Artificial Sequence
  Synthetic oligonucleotide
tcccgcgcgctagggtaatgatccagcagacatgta

SEQ ID NO: 817 - DNA, 36 bp, Artificial Sequence
  Synthetic oligonucleotide
tcgtagtactcgcgcttcccgtatcacaattttgaa

SEQ ID NO: 818 - DNA, 37 bp, Artificial Sequence
  Synthetic oligonucleotide
aggtcgcgcgccagggacgtgctgcagaaccacctga

SEQ ID NO: 819 - DNA, 36 bp, Artificial Sequence
  Synthetic oligonucleotide
tctaccgcgcgcttggaggaacgttccggactggca

SEQ ID NO: 820 - DNA, 35 bp, Artificial Sequence
  Synthetic oligonucleotide
gcaaaataataccgctacattctctacaactcgcc

SEQ ID NO: 821 - DNA, 36 bp, Artificial Sequence
  Synthetic oligonucleotide
gcgtggggtgcgcgctaaccacacttgaccagacta

SEQ ID NO: 822 - DNA, 35 bp, Artificial Sequence
  Synthetic oligonucleotide
cccggcgagccacgggctgtacgagcaagtcacac

SEQ ID NO: 823 - DNA, 36 bp, Artificial Sequence
  Synthetic oligonucleotide
gcgaggaccatcccgcgtgcctgggagtcactttaa

SEQ ID NO: 824 - DNA, 38 bp, Artificial Sequence
  Synthetic oligonucleotide
atgcacggatgcggctagcgatctcccctaaacactga

SEQ ID NO: 825 - DNA, 37 bp, Artificial Sequence
  Synthetic oligonucleotide
atgcactgtacgtagagtaatgcggttcattccttga

SEQ ID NO: 826 - DNA, 35 bp, Artificial Sequence
  Synthetic oligonucleotide
gatcgtaacgctgcaaggtcactccgggaaaacca

SEQ ID NO: 827 - DNA, 38 bp, Artificial Sequence
  Synthetic oligonucleotide
cctgcgcgctaggggagatactggttcgtgcgatttga

SEQ ID NO: 828 - DNA, 35 bp, Artificial Sequence
  Synthetic oligonucleotide
acgcgtgctaggacggactgaacggtaaaactaag

SEQ ID NO: 829 - DNA, 38 bp, Artificial Sequence
  Synthetic oligonucleotide
actgcagagtatgcaagcttgaccaccatacgctttga

SEQ ID NO: 830 - DNA, 37 bp, Artificial Sequence
  Synthetic oligonucleotide
catgcgcaggctttctctttagttctcttctggttga

SEQ ID NO: 831 - DNA, 35 bp, Artificial Sequence
  Synthetic oligonucleotide
tcaagcgaatctagcggtacacctcgcaggctcgc

SEQ ID NO: 832 - DNA, 35 bp, Artificial Sequence
  Synthetic oligonucleotide
catgcaagcttcgttcaacatccaacctagctgta

SEQ ID NO: 833 - DNA, 35 bp, Artificial Sequence
  Synthetic oligonucleotide
gcgtgccaacgttgcatcaactattttcatgaatt

SEQ ID NO: 834 - DNA, 38 bp, Artificial Sequence
  Synthetic oligonucleotide
gcgtgctgtgactccaccgtgccttatactttgaatga

SEQ ID NO: 835 - DNA, 36 bp, Artificial Sequence
  Synthetic oligonucleotide
catgcgcaagcttcaacgacacaactaaacctgcta

SEQ ID NO: 836 - DNA, 36 bp, Artificial Sequence
  Synthetic oligonucleotide
ggctgaccacgatgaagtttgcgcaagcttttatta

SEQ ID NO: 837 - DNA, 37 bp, Artificial Sequence
  Synthetic oligonucleotide
aacgcgagcctgtacggtactgcccctatcccaccga

SEQ ID NO: 838 - DNA, 35 bp, Artificial Sequence
  Synthetic oligonucleotide
gcgggcctacgactgcaggacccctgacccattct

SEQ ID NO: 839 - DNA, 36 bp, Artificial Sequence
  Synthetic oligonucleotide
gctaactgcgtgtcatttcggtttcctacatccata

SEQ ID NO: 840 - DNA, 36 bp, Artificial Sequence
  Synthetic oligonucleotide
ccggatctaggagagtactggctgcacatgcgacaa

SEQ ID NO: 841 - DNA, 36 bp, Artificial Sequence
  Synthetic oligonucleotide
tacgcgcgactaacattaatgcggtcttatcatcca

SEQ ID NO: 842 - DNA, 38 bp, Artificial Sequence
  Synthetic oligonucleotide
cgccgcgccagggtactgcaggaagcgctacgacttga

SEQ ID NO: 843 - DNA, 35 bp, Artificial Sequence
  Synthetic oligonucleotide
gcagtcagcaacgcttctttatgtcatacccgctt

SEQ ID NO: 844 - DNA, 35 bp, Artificial Sequence
  Synthetic oligonucleotide
catgcgaaagcttctcatacttgatcacgtttccc

SEQ ID NO: 845 - DNA, 36 bp, Artificial Sequence
  Synthetic oligonucleotide
cacgcggttcgtagcggaatgtactggtcaatccta

SEQ ID NO: 846 - DNA, 36 bp, Artificial Sequence
  Synthetic oligonucleotide
ccggggctaggaacgggggcagtcagagcgaccata

SEQ ID NO: 847 - DNA, 35 bp, Artificial Sequence
  Synthetic oligonucleotide
ccggcagtcttatctctactgtgccttctttaatc

SEQ ID NO: 848 - DNA, 38 bp, Artificial Sequence
  Synthetic oligonucleotide
gagttgcgagcatgcggacgcttttgttttgcttttga

SEQ ID NO: 849 - DNA, 38 bp, Artificial Sequence
  Synthetic oligonucleotide
tacgcaggagggccatgacgctgactatacgcttttga

SEQ ID NO: 850 - DNA, 38 bp, Artificial Sequence
  Synthetic oligonucleotide
ttctgcgcaatttcaaccctctactgtgcccaatttga

SEQ ID NO: 851 - DNA, 35 bp, Artificial Sequence
  Synthetic oligonucleotide
tcataccctcatgatcatgcagtcaccactcttag

SEQ ID NO: 852 - DNA, 38 bp, Artificial Sequence
  Synthetic oligonucleotide
gcggagctagcacggtactgcgcataaactatgattga

SEQ ID NO: 853 - DNA, 35 bp, Artificial Sequence
  Synthetic oligonucleotide
gaccggaactaggtacggctgcagagcgcaaccgc

SEQ ID NO: 854 - DNA, 38 bp, Artificial Sequence
  Synthetic oligonucleotide
tcgtagtcaccgcgggtcatccactattaacaccttga

SEQ ID NO: 855 - DNA, 35 bp, Artificial Sequence
  Synthetic oligonucleotide
acgcgacagctacgagtccccgcggagtgcaacgc

SEQ ID NO: 856 - DNA, 36 bp, Artificial Sequence
  Synthetic oligonucleotide
tcacctactagggaaggccacacggcacgcacatta

SEQ ID NO: 857 - DNA, 37 bp, Artificial Sequence
  Synthetic oligonucleotide
aaccggaactaggtgtgggacctgaaggcatggacga

SEQ ID NO: 858 - DNA, 37 bp, Artificial Sequence
  Synthetic oligonucleotide
gtaaactgcgctcttcttcgccctcccctgtctcgga

SEQ ID NO: 859 - DNA, 35 bp, Artificial Sequence
  Synthetic oligonucleotide
tcccatcgccggacgctccatatctttcggatcct

SEQ ID NO: 860 - DNA, 36 bp, Artificial Sequence
  Synthetic oligonucleotide
tgcctctaccgtgccgtgttgattttctccattcta

SEQ ID NO: 861 - DNA, 38 bp, Artificial Sequence
  Synthetic oligonucleotide
gcgggccgtgactgtttaccactctactgtgcgattga

SEQ ID NO: 862 - DNA, 35 bp, Artificial Sequence
  Synthetic oligonucleotide
gcgatccatgacgaccaatatataccgctttgaca

SEQ ID NO: 863 - DNA, 36 bp, Artificial Sequence
  Synthetic oligonucleotide
tgtactctctactgtgcccttcctgagtgtttatca

SEQ ID NO: 864 - DNA, 36 bp, Artificial Sequence
  Synthetic oligonucleotide
taaggcgaaactagctgaaggtactgcgaattttta

SEQ ID NO: 865 - DNA, 37 bp, Artificial Sequence
  Synthetic oligonucleotide
atgcacggtacggaaggattctgccttcccatcacga

SEQ ID NO: 866 - DNA, 36 bp, Artificial Sequence
  Synthetic oligonucleotide
ggtcgcgtgccaggcacggagatgcggtcctttgca

SEQ ID NO: 867 - DNA, 35 bp, Artificial Sequence
  Synthetic oligonucleotide
aacctgaaggaaccgcatctctaccgtgcctatat

SEQ ID NO: 868 - DNA, 35 bp, Artificial Sequence
  Synthetic oligonucleotide
catgcaggctttccaacccactttaatagctaact

SEQ ID NO: 869 - DNA, 36 bp, Artificial Sequence
  Synthetic oligonucleotide
tcatgccaggctttttctttgaattccgatttaata

SEQ ID NO: 870 - DNA, 36 bp, Artificial Sequence
  Synthetic oligonucleotide
gcgttagatctctaccgtgctcaacctcttctgtaa

SEQ ID NO: 871 - DNA, 36 bp, Artificial Sequence
  Synthetic oligonucleotide
gtgacgccgctatctttacaactctactgtgcttta

SEQ ID NO: 872 - DNA, 36 bp, Artificial Sequence
  Synthetic oligonucleotide
tattgcgaactcctctgagctacggtacgtgtggca

SEQ ID NO: 873 - DNA, 35 bp, Artificial Sequence
  Synthetic oligonucleotide
tctatcaactcgccccaaattacccgccccacata

SEQ ID NO: 874 - DNA, 35 bp, Artificial Sequence
  Synthetic oligonucleotide
catgtctaggtctttcgtaatcctctaccgtgcca

SEQ ID NO: 875 - DNA, 36 bp, Artificial Sequence
  Synthetic oligonucleotide
ctgcggtcagtgcccatccgctcccaactagcctta

SEQ ID NO: 876 - DNA, 38 bp, Artificial Sequence
  Synthetic oligonucleotide
ccactccaccgtgcccttctataggttttctcaactga

SEQ ID NO: 877 - DNA, 35 bp, Artificial Sequence
  Synthetic oligonucleotide
gccttcccacgtcgagtcagttcgacgtccccgtt

SEQ ID NO: 878 - DNA, 38 bp, Artificial Sequence
  Synthetic oligonucleotide
tcatccttttactcgaccgtgccccccttagttcctga

SEQ ID NO: 879 - DNA, 36 bp, Artificial Sequence
  Synthetic oligonucleotide
taaaggccacgcatcccccgttaaaacatcattaaa

SEQ ID NO: 880 - DNA, 36 bp, Artificial Sequence
  Synthetic oligonucleotide
ttcttctccactgtgccccaactcaatttttgatta

SEQ ID NO: 881 - DNA, 36 bp, Artificial Sequence
  Synthetic oligonucleotide
tctccaccgtgccatcgaaaatttactctctgctca

SEQ ID NO: 882 - DNA, 38 bp, Artificial Sequence
  Synthetic oligonucleotide
taacctactaaggcatgtcgactctatcatatgcttga

SEQ ID NO: 883 - DNA, 36 bp, Artificial Sequence
  Synthetic oligonucleotide
aaaggcatgacatatatcctctaccgtgcccgccta

SEQ ID NO: 884 - DNA, 36 bp, Artificial Sequence
  Synthetic oligonucleotide
catgccagatttcgcactagttacctccttagctta

SEQ ID NO: 885 - DNA, 38 bp, Artificial Sequence
  Synthetic oligonucleotide
catgccggagcgatttattcaatatcttctatgagtga

SEQ ID NO: 886 - DNA, 35 bp, Artificial Sequence
  Synthetic oligonucleotide
atcgtagtacaaaagggggttatctcttggtttcg

SEQ ID NO: 887 - DNA, 35 bp, Artificial Sequence
  Synthetic oligonucleotide
tagacatatcgttctggactttttctccactgtgc

SEQ ID NO: 888 - DNA, 37 bp, Artificial Sequence
  Synthetic oligonucleotide
atcgtagtactgtggtccgccactacccgaactatga

SEQ ID NO: 889 - DNA, 37 bp, Artificial Sequence
  Synthetic oligonucleotide
gaagagccccgcctgcttccttatccagatcatgcga

SEQ ID NO: 890 - DNA, 35 bp, Artificial Sequence
  Synthetic oligonucleotide
gcgcgatacgacatctccttagcttttgttttgct

SEQ ID NO: 891 - DNA, 35 bp, Artificial Sequence
  Synthetic oligonucleotide
gacgtcatggccaccctagcttcatttcttgcttt

SEQ ID NO: 892 - DNA, 38 bp, Artificial Sequence
  Synthetic oligonucleotide
ccggtcgtaggactaccgccaggcatattattgtttga

SEQ ID NO: 893 - DNA, 36 bp, Artificial Sequence
  Synthetic oligonucleotide
tgtggtagtacgcagtcagtcgctgtatcccgctaa

SEQ ID NO: 894 - DNA, 38 bp, Artificial Sequence
  Synthetic oligonucleotide
tatgcgcccctggtctatattcggaaaaccctacctga

SEQ ID NO: 895 - DNA, 35 bp, Artificial Sequence
  Synthetic oligonucleotide
ttaggtatcatgcggccacctggtctaatattttt

SEQ ID NO: 896 - DNA, 35 bp, Artificial Sequence
  Synthetic oligonucleotide
tcgtagtactcagggccccaccaaatttcttaaat

SEQ ID NO: 897 - DNA, 35 bp, Artificial Sequence
  Synthetic oligonucleotide
accgcgcgcctggtatcctgctatgtctagtccct

SEQ ID NO: 898 - DNA, 35 bp, Artificial Sequence
  Synthetic oligonucleotide
gatcgtagcgtacgtaggaaatccccgaaacaacg

SEQ ID NO: 899 - DNA, 37 bp, Artificial Sequence
  Synthetic oligonucleotide
cgtgccatggctttaaccgtatcttcgctttttctga

SEQ ID NO: 900 - DNA, 36 bp, Artificial Sequence
  Synthetic oligonucleotide
gcgatcgtagcacggtaaactggcccccttgcaata

SEQ ID NO: 901 - DNA, 36 bp, Artificial Sequence
  Synthetic oligonucleotide
acgcactgtataaagtctacgcgcccttcaaccata

SEQ ID NO: 902 - DNA, 38 bp, Artificial Sequence
  Synthetic oligonucleotide
cttacgcgtgcttggaacgatgtattgcggccaattga

SEQ ID NO: 903 - DNA, 36 bp, Artificial Sequence
  Synthetic oligonucleotide
tcgtaggactgcaaaccacacgccttgttcgaaaaa

SEQ ID NO: 904 - DNA, 35 bp, Artificial Sequence
  Synthetic oligonucleotide
ccgggtctaggacggctctgttgtctcctccctgt

SEQ ID NO: 905 - DNA, 35 bp, Artificial Sequence
  Synthetic oligonucleotide
atcgtagcactgcagggcgcctagtttacaatggg

SEQ ID NO: 906 - DNA, 35 bp, Artificial Sequence
  Synthetic oligonucleotide
gacgtcatcgtgccttcttggctgaccgtacagga

SEQ ID NO: 907 - DNA, 38 bp, Artificial Sequence
  Synthetic oligonucleotide
ttcatccgcgcgaatgaaaccgatctacatccctatga

SEQ ID NO: 908 - DNA, 35 bp, Artificial Sequence
  Synthetic oligonucleotide
atcgtagtaccataccccgcatgccgccaaaattt

SEQ ID NO: 909 - DNA, 37 bp, Artificial Sequence
  Synthetic oligonucleotide
aaacccgcgagcaggcattgaactcccctgaatacga

SEQ ID NO: 910 - DNA, 37 bp, Artificial Sequence
  Synthetic oligonucleotide
gcaatgacgtgcgttcgaccgattatctctactatga

SEQ ID NO: 911 - DNA, 36 bp, Artificial Sequence
  Synthetic oligonucleotide
aagcactgtacggaagtaggcccgcccccaaattaa

SEQ ID NO: 912 - DNA, 35 bp, Artificial Sequence
  Synthetic oligonucleotide
tcgtagtatctggaggtcgtgcgttgcactattac

SEQ ID NO: 913 - DNA, 36 bp, Artificial Sequence
  Synthetic oligonucleotide
gatcgtatacgtacgctaggtctctttcgcttatca

SEQ ID NO: 914 - DNA, 36 bp, Artificial Sequence
  Synthetic oligonucleotide
tgggcaaccggaactagtacagcccacgtacgttga

SEQ ID NO: 915 - DNA, 36 bp, Artificial Sequence
  Synthetic oligonucleotide
tcgcaaactcagcttcctctctaccgtgcatgttaa

SEQ ID NO: 916 - DNA, 38 bp, Artificial Sequence
  Synthetic oligonucleotide
gcgcgctaacaccctgcggtacaccaggaactccttga

SEQ ID NO: 917 - DNA, 35 bp, Artificial Sequence
  Synthetic oligonucleotide
ccggtcactgctggagtgcgaaagctttctcttgt

SEQ ID NO: 918 - DNA, 36 bp, Artificial Sequence
  Synthetic oligonucleotide
gcagaaggaaatgcgcgctaattgacaacgctcgaa

SEQ ID NO: 919 - DNA, 38 bp, Artificial Sequence
  Synthetic oligonucleotide
accgcgcgcctgggaccgtaatggatcctacataatga

SEQ ID NO: 920 - DNA, 36 bp, Artificial Sequence
  Synthetic oligonucleotide
gcgatcgtagctaagggatctactagggaatgccca

SEQ ID NO: 921 - DNA, 35 bp, Artificial Sequence
  Synthetic oligonucleotide
ttacctaccagggatgcggccccgaagccattctt

SEQ ID NO: 922 - DNA, 38 bp, Artificial Sequence
  Synthetic oligonucleotide
taggcaactaatgcagagacgcgacccacgacatttga

SEQ ID NO: 923 - DNA, 35 bp, Artificial Sequence
  Synthetic oligonucleotide
ctcctagcaggcgggccctgacaggcggtcgtagc

SEQ ID NO: 924 - DNA, 35 bp, Artificial Sequence
  Synthetic oligonucleotide
tcacctaccacggtcatctttacttgagacaacaa

SEQ ID NO: 925 - DNA, 35 bp, Artificial Sequence
  Synthetic oligonucleotide
taagcaactcctgccgtgccattaaagcttttata

SEQ ID NO: 926 - DNA, 36 bp, Artificial Sequence
  Synthetic oligonucleotide
taccgctgccatgaatcatctctgttaaactagcca

SEQ ID NO: 927 - DNA, 37 bp, Artificial Sequence
  Synthetic oligonucleotide
gagtacgcgacgccttggtctactactcttccctgga

SEQ ID NO: 928 - DNA, 35 bp, Artificial Sequence
  Synthetic oligonucleotide
gcggtcgtagcaacactgcatcctcatgatactta

SEQ ID NO: 929 - DNA, 35 bp, Artificial Sequence
  Synthetic oligonucleotide
tccgacggggcatcgtgtcaggcgcatgaaatttt

SEQ ID NO: 930 - DNA, 35 bp, Artificial Sequence
  Synthetic oligonucleotide
atcgtagtagtgccgcgctagcctgacgcaaaatt

SEQ ID NO: 931 - DNA, 38 bp, Artificial Sequence
  Synthetic oligonucleotide
aggcgtgcatgacgatttaattaaccaccgaaccatga

SEQ ID NO: 932 - DNA, 36 bp, Artificial Sequence
  Synthetic oligonucleotide
catcatacgaccgcgtgattggtgagttgtaacgga

SEQ ID NO: 933 - DNA, 35 bp, Artificial Sequence
  Synthetic oligonucleotide
catgcaagcttggattttctcacgtttcattgtta

SEQ ID NO: 934 - DNA, 35 bp, Artificial Sequence
  Synthetic oligonucleotide
gcgcataggctttttatatttattctctatgcttt

SEQ ID NO: 935 - DNA, 35 bp, Artificial Sequence
  Synthetic oligonucleotide
gcccgattccagaaaccacgcttttaccatttcct

SEQ ID NO: 936 - DNA, 37 bp, Artificial Sequence
  Synthetic oligonucleotide
gctagcattggcttttgtttatttgcttctatcttga

SEQ ID NO: 937 - DNA, 35 bp, Artificial Sequence
  Synthetic oligonucleotide
gcgctactagccgatatatttccgttccactcttt

SEQ ID NO: 938 - DNA, 36 bp, Artificial Sequence
  Synthetic oligonucleotide
gactaaatacctcactatctccactgtgccgttaaa

SEQ ID NO: 939 - DNA, 35 bp, Artificial Sequence
  Synthetic oligonucleotide
gcaaattctgttcgatccacactattaactcgctt

SEQ ID NO: 940 - DNA, 37 bp, Artificial Sequence
  Synthetic oligonucleotide
gaatcatccggccctaaactccactgtgccctcttga

SEQ ID NO: 941 - DNA, 35 bp, Artificial Sequence
  Synthetic oligonucleotide
tgctaggtgatgaattaatttggtctctttttggt

SEQ ID NO: 942 - DNA, 35 bp, Artificial Sequence
  Synthetic oligonucleotide
gcctacaggatttttgattgatcgatttcgcttct

SEQ ID NO: 943 - DNA, 36 bp, Artificial Sequence
  Synthetic oligonucleotide
catgcaattcttcgcttcctattccttaagcttgta

SEQ ID NO: 944 - DNA, 36 bp, Artificial Sequence
  Synthetic oligonucleotide
gctaactgcttggcgtgcgagctgaaccaacgctta

SEQ ID NO: 945 - DNA, 36 bp, Artificial Sequence
  Synthetic oligonucleotide
gccgaaaacatcgctgttcgtcttatcaactcgccc

SEQ ID NO: 946 - DNA, 36 bp, Artificial Sequence
  Synthetic oligonucleotide
atgcctgtccaaaaactctaccgtgccgtgttacta

SEQ ID NO: 947 - DNA, 37 bp, Artificial Sequence
  Synthetic oligonucleotide
catgcgtcgattcactatcttcgctttcaattgctga

SEQ ID NO: 948 - DNA, 35 bp, Artificial Sequence
  Synthetic oligonucleotide
gtcaaatgtcaatgggcaccacgcactgttcgcgc

SEQ ID NO: 949 - DNA, 36 bp, Artificial Sequence
  Synthetic oligonucleotide
gcgacacgattggtcaattcctcgctttcctctcta

SEQ ID NO: 950 - DNA, 36 bp, Artificial Sequence
  Synthetic oligonucleotide
catagggacggaacgggcacggtagctcctaacgta

SEQ ID NO: 951 - DNA, 36 bp, Artificial Sequence
  Synthetic oligonucleotide
taggcaactactaggtgatgcgtcaattacctctta

SEQ ID NO: 952 - DNA, 38 bp, Artificial Sequence
  Synthetic oligonucleotide
tcacctaccacaagatcgtgcccctgaatcacttgtga

SEQ ID NO: 953 - DNA, 36 bp, Artificial Sequence
  Synthetic oligonucleotide
agtcaggcatggtagacgcttctacttcgctttcta

SEQ ID NO: 954 - DNA, 37 bp, Artificial Sequence
  Synthetic oligonucleotide
taacctaccaagtacatgacctttcacttgatcttga

SEQ ID NO: 955 - DNA, 38 bp, Artificial Sequence
  Synthetic oligonucleotide
tatgccagcttctcatatatcccgctttctatcaatga

SEQ ID NO: 956 - DNA, 35 bp, Artificial Sequence
  Synthetic oligonucleotide
gaagccgcgcgccaagcaaagggtactgcccctct

SEQ ID NO: 957 - DNA, 36 bp, Artificial Sequence
  Synthetic oligonucleotide
atgcacggtgcggccggtcatgcaagacacttcgta

SEQ ID NO: 958 - DNA, 35 bp, Artificial Sequence
  Synthetic oligonucleotide
ttcatttatctccaccgtgcactccatggatctta

SEQ ID NO: 959 - DNA, 36 bp, Artificial Sequence
  Synthetic oligonucleotide
gcaggcttcgaatcctccactgtgctaatacatgaa

SEQ ID NO: 960 - DNA, 35 bp, Artificial Sequence
  Synthetic oligonucleotide
atgcactgttgtgatcggcctgagcaggcgcccaa

SEQ ID NO: 961 - DNA, 38 bp, Artificial Sequence
  Synthetic oligonucleotide
aacccctcgccgcgtgcctggcgacggagtagtaatga

SEQ ID NO: 962 - DNA, 37 bp, Artificial Sequence
  Synthetic oligonucleotide
actccaccgtgccctttaatctcatgtgccacactga

SEQ ID NO: 963 - DNA, 35 bp, Artificial Sequence
  Synthetic oligonucleotide
gcgattatattaatttctctaccgtgcgatcccaa

SEQ ID NO: 964 - DNA, 35 bp, Artificial Sequence
  Synthetic oligonucleotide
atgcatcagcgcgcttattaatcaatcgcttttgt

SEQ ID NO: 965 - DNA, 34 bp, Artificial Sequence
  Synthetic oligonucleotide
gcgtgccagcgtactcgcatctcacagaacccgt

SEQ ID NO: 966 - DNA, 35 bp, Artificial Sequence
  Synthetic oligonucleotide
caaccactattcgcgtgccagggtggggaaacgtt

SEQ ID NO: 967 - DNA, 36 bp, Artificial Sequence
  Synthetic oligonucleotide
tatgcaaccgggactgagagtcctagcgctttttta

SEQ ID NO: 968 - DNA, 36 bp, Artificial Sequence
  Synthetic oligonucleotide
gcccgctttgtcaccggaattaattaactcgcctca

SEQ ID NO: 969 - DNA, 35 bp, Artificial Sequence
  Synthetic oligonucleotide
tcacctactagattcgtgccagaatttcaaatttc

SEQ ID NO: 970 - DNA, 25 bp, Artificial Sequence
  Synthetic oligonucleotide
cgaaagccatgacctccgatcactc

SEQ ID NO: 971 - DNA, 35 bp, Artificial Sequence
  Synthetic oligonucleotide
cctcaagacctaagcgacagcgtgaccttgtttca

SEQ ID NO: 972 - DNA, 68 bp, Artificial Sequence
  Synthetic oligonucleotide
caagtttccaggtagtttgcgtgttttacgtaccctcaagacctaagcgacagcgtgaccttgtttca

SEQ ID NO: 973 - DNA, 66 bp, Artificial Sequence
  Synthetic oligonucleotide
cagggtaggtatcgtgagtgttttacgtactcatcctcttcttttcttggtgttgagaagatgctc

SEQ ID NO: 974 - DNA, 69 bp, Artificial Sequence
  Synthetic oligonucleotide
gaaagtacaggaaaatgcctgctgttttacgtaccacaattctgcgggttagcaggaaggttagggaac

SEQ ID NO: 975 - DNA, 63 bp, Artificial Sequence
  Synthetic oligonucleotide
gagacagagtagggccaatgcgataatgctgttgagattattgagcttcatcatgaccagaag

SEQ ID NO: 976 - DNA, 66 bp, Artificial Sequence
  Synthetic oligonucleotide
gagacagagaaaaagggatagttcgttcggtcaaagacgcctatcttccagtttgatcgggaaact

SEQ ID NO: 977 - DNA, 58 bp, Artificial Sequence
  Synthetic oligonucleotide
gacgcgtggtgggttttacgtaccgaacctaactcctcgctacattcctattgttttc

SEQ ID NO: 978 - DNA, 57 bp, Artificial Sequence
  Synthetic oligonucleotide
gcgcaggaccggttttacgtacccaatttggttttactcccctcgattatgcggagt

SEQ ID NO: 979 - DNA, 60 bp, Artificial Sequence
  Synthetic oligonucleotide
gagacagaaagtcgcatgggcagtactttcgggttatatctatcatttacttgacaccct

SEQ ID NO: 980 - DNA, 67 bp, Artificial Sequence
  Synthetic oligonucleotide
agtggagtttaattggccttcagttacgtactcaacagccactttttttccaaattttgcaagagcc

SEQ ID NO: 981 - DNA, 66 bp, Artificial Sequence
  Synthetic oligonucleotide
gaacgattcgtagggtatgcatgtacgtactcaccgtgtggacggcaactcagagataacgcatat

SEQ ID NO: 982 - DNA, 60 bp, Artificial Sequence
  Synthetic oligonucleotide
agtatcaacgccggcatgtacgtaccctggagtttatgtattgccaacgagtttgtcttt

SEQ ID NO: 983 - DNA, 60 bp, Artificial Sequence
  Synthetic oligonucleotide
taaagggcgtggcatgtctacgtaccagataaggttgttattgtggaggatgttactaca

SEQ ID NO: 984 - DNA, 66 bp, Artificial Sequence
  Synthetic oligonucleotide
gagacagaacattggcacagtagagataggtcttccttcctgtgttccagctacaaacttagaaac

SEQ ID NO: 985 - DNA, 63 bp, Artificial Sequence
  Synthetic oligonucleotide
taatggcagccttacgtacctacgtactcataaaattggttttgcctttcagcaattcaactt

SEQ ID NO: 986 - DNA, 55 bp, Artificial Sequence
  Synthetic oligonucleotide
cgggcgcactgactacgtacctggtcaagacttgcatgaggacccgcaaattcct

SEQ ID NO: 987 - DNA, 57 bp, Artificial Sequence
  Synthetic oligonucleotide
gagacaggaagggcaccgtagactttcgttgggacgcttgaagcgcaagtagaaaac

SEQ ID NO: 988 - DNA, 58 bp, Artificial Sequence
  Synthetic oligonucleotide
ccatcgcgactgcactacgtactccagcagacctgcaatatcaaagttataagcgcgt

SEQ ID NO: 989 - DNA, 63 bp, Artificial Sequence
  Synthetic oligonucleotide
gagacagtcaaggcacagtggagtaatgcctgccaatgcactcgatcttgtcatttttttgcg

SEQ ID NO: 990 - DNA, 67 bp, Artificial Sequence
  Synthetic oligonucleotide
ggtagagaatacaagggtctgcaactacgtaccaaactggagagagaagtgaagacgatttaaccca

SEQ ID NO: 991 - DNA, 57 bp, Artificial Sequence
  Synthetic oligonucleotide
cggttcgcatggccatacgtaccgattgctgcattccgctcaacgcttgaggaagta

SEQ ID NO: 992 - DNA, 60 bp, Artificial Sequence
  Synthetic oligonucleotide
gaaggggatgaccgcaatacgtactctgaggctgttaaagctgtagcaactcttccacga

SEQ ID NO: 993 - DNA, 58 bp, Artificial Sequence
  Synthetic oligonucleotide
ccagtgacctgcagtgacgtactctaggacgcaaatcacttgaagaagtgaaagcgag

SEQ ID NO: 994 - DNA, 69 bp, Artificial Sequence
  Synthetic oligonucleotide
tggagttcaacaatatcagttagcagtgacgtacccacgcgatgacgttcgtcaagagtcgcataatct

SEQ ID NO: 995 - DNA, 58 bp, Artificial Sequence
  Synthetic oligonucleotide
cctgccacagtacctgacgtactcatttggaatgatgtgtactgggaataagacgacg

SEQ ID NO: 996 - DNA, 58 bp, Artificial Sequence
  Synthetic oligonucleotide
ctggactgctgacctgacgtactcacaagaatccctgctagctgaaggagggtcaaac

SEQ ID NO: 997 - DNA, 66 bp, Artificial Sequence
  Synthetic oligonucleotide
gaaaaatgacagacagcggttactgacgtaccttgacgtagattgctatcaggttacgatgactgc

SEQ ID NO: 998 - DNA, 64 bp, Artificial Sequence
  Synthetic oligonucleotide
aggttcgacgactacagttactgacgtaccttacagatcgtgtgctcatgacttccacagacgt

SEQ ID NO: 999 - DNA, 61 bp, Artificial Sequence
  Synthetic oligonucleotide
cgcatgagcttccttactgacgtactcttggaggagttgatagtggtaaaacaacattagc

SEQ ID NO: 1000 - DNA, 65 bp, Artificial Sequence
  Synthetic oligonucleotide
gagacagtcaagtatttacaagtggcgcagcctacgtatatatccaagtggttatgtccgacggc

SEQ ID NO: 1001 - DNA, 75 bp, Artificial Sequence
  Synthetic oligonucleotide
gagacagtaaaataagagagaacgtactagcttcgcattacagcaagaaggagtatggaacttatagcaagagag

SEQ ID NO: 1002 - DNA, 66 bp, Artificial Sequence
  Synthetic oligonucleotide
ggaaagaatcgcgatgtttgtactgacgtaccacccctccaaacgcattcttattggcaaatggaa

SEQ ID NO: 1003 - DNA, 57 bp, Artificial Sequence
  Synthetic oligonucleotide
ggcgtttacgggcatgacgtaccccgaagcaatactgtcgtcactctgtatgtccgt

SEQ ID NO: 1004 - DNA, 57 bp, Artificial Sequence
  Synthetic oligonucleotide
gtcgaaaggcggcatgacgtacccgggaatcggcatttcgcattcttaggatctaaa

SEQ ID NO: 1005 - DNA, 70 bp, Artificial Sequence
  Synthetic oligonucleotide
gagacaggagtgaatgagtttgagtatggaatgacccgatcttcataacggacaaactgaacgggccatt

SEQ ID NO: 1006 - DNA, 64 bp, Artificial Sequence
  Synthetic oligonucleotide
gttaatggaagcttgtcgcatgacgtactcgctatgcagacgagctggcagaggagagaaatca

SEQ ID NO: 1007 - DNA, 63 bp, Artificial Sequence
  Synthetic oligonucleotide
atgataagggtagctcgcatgacgtactcattcgcaaccatgtgaagtaatgtgagcgtactt

SEQ ID NO: 1008 - DNA, 56 bp, Artificial Sequence
  Synthetic oligonucleotide
ggcgcaatcgcatgacgtactcaccagttagcgtggcgtataccatgttgttaaca

SEQ ID NO: 1009 - DNA, 67 bp, Artificial Sequence
  Synthetic oligonucleotide
gagacagtgataatttagggctacggagtacgcctgaatcaatagaacaatatcagttatggcggtg

SEQ ID NO: 1010 - DNA, 67 bp, Artificial Sequence
  Synthetic oligonucleotide
gagacagatgattagggtagtagagaacgcaccggttgttaatatgacaggccgctaaagacgttct

SEQ ID NO: 1011 - DNA, 68 bp, Artificial Sequence
  Synthetic oligonucleotide
gagacagtttgaatcatgagtttgtgaaagcgtccgtctcagatgagtgggttaatcaatcaagtatg

SEQ ID NO: 1012 - DNA, 64 bp, Artificial Sequence
  Synthetic oligonucleotide
gagagaataggacgtacgcatgacgtactctgacacattagtaacgtcggcaagcacttagtcg

SEQ ID NO: 1013 - DNA, 58 bp, Artificial Sequence
  Synthetic oligonucleotide
tgggtgtgcgtacatgacgtactcgtgaaccagattatgtatggacgcgcaatagata

SEQ ID NO: 1014 - DNA, 58 bp, Artificial Sequence
  Synthetic oligonucleotide
ggtttccgcattgcaggacgtaccatacgaaatttgagcaagcaattgaaggcttaga

SEQ ID NO: 1015 - DNA, 53 bp, Artificial Sequence
  Synthetic oligonucleotide
ccctggctcgcgacgtacctatcagctaatagggtcggctcaacagtgtatcc

SEQ ID NO: 1016 - DNA, 62 bp, Artificial Sequence
  Synthetic oligonucleotide
cagtagagaacaagtcgcacgacgtacctatcaattcgtgaccccgatcatccagtccagaa

SEQ ID NO: 1017 - DNA, 61 bp, Artificial Sequence
  Synthetic oligonucleotide
gagacaggcaaagatgaaagcgcatgcttgagctctaggcccaaaacgaccttaatggtca

SEQ ID NO: 1018 - DNA, 52 bp, Artificial Sequence
  Synthetic oligonucleotide
tgcccgccctcacgtacctagcccagatcctacgagatgagctacgtaacta

SEQ ID NO: 1019 - DNA, 55 bp, Artificial Sequence
  Synthetic oligonucleotide
gttggaccgccctcacgtaccaaatgcactctatatggagggagagtagctggat

SEQ ID NO: 1020 - DNA, 57 bp, Artificial Sequence
  Synthetic oligonucleotide
actcctgtacgccctcacgtaccctggtctaggtatctaattcgtgggtcgggtact

SEQ ID NO: 1021 - DNA, 63 bp, Artificial Sequence
  Synthetic oligonucleotide
gccattaacttcagtagccctcacgtaccattagctcggatgctatcagcttgcgcctattat

SEQ ID NO: 1022 - DNA, 65 bp, Artificial Sequence
  Synthetic oligonucleotide
gagacaggataaaggtaagaaaagcggctgcacgatctgtattttgcacctttcgctatgctgag

SEQ ID NO: 1023 - DNA, 64 bp, Artificial Sequence
  Synthetic oligonucleotide
gagacagtcaggaaggaaaatgtacgcacctgtgtccgtctatacgcatactggtccacatata

SEQ ID NO: 1024 - DNA, 62 bp, Artificial Sequence
  Synthetic oligonucleotide
gagacagagggacaaggaggaaattggcatgttggagttaacggagacccgccatcgtttac

SEQ ID NO: 1025 - DNA, 53 bp, Artificial Sequence
  Synthetic oligonucleotide
ggacggcccctcacgtaccgctcattttgaacatacgattgcgattacggaaa

SEQ ID NO: 1026 - DNA, 55 bp, Artificial Sequence
  Synthetic oligonucleotide
atgaccgcccctcacgtactcctatgcatcatgtgcctcactaggacatcatgct

SEQ ID NO: 1027 - DNA, 66 bp, Artificial Sequence
  Synthetic oligonucleotide
cacagtagaggaatatgcgctatcacgtactcctaaattgggaaaaaaggttttagctattgatgg

SEQ ID NO: 1028 - DNA, 59 bp, Artificial Sequence
  Synthetic oligonucleotide
gagacagtcattgggcacggtagacttcagttaaaggctatcttgctccgctcgttctc

SEQ ID NO: 1029 - DNA, 61 bp, Artificial Sequence
  Synthetic oligonucleotide
gcacggtagagagtagttgcacgtaccttaaagctatccacgaatgtcaaaaatgtggttt

SEQ ID NO: 1030 - DNA, 73 bp, Artificial Sequence
  Synthetic oligonucleotide
gagacagtatgagataagcacagtagagattgacatgtcccgaatgtataatgctgacgttcttgcttttggc

SEQ ID NO: 1031 - DNA, 58 bp, Artificial Sequence
  Synthetic oligonucleotide
gagacagtaggggcacggtagagcctattgaagcaatcctctccccaatacttaaaaa

SEQ ID NO: 1032 - DNA, 54 bp, Artificial Sequence
  Synthetic oligonucleotide
gggggtgtcctgcacgtacctacggttaccgtctttataagtgaacaaaaccgg

SEQ ID NO: 1033 - DNA, 63 bp, Artificial Sequence
  Synthetic oligonucleotide
gtagagtatccacgcaaactgcacgtacctctgtgaactgtcatcggtccgatcaattagtct

SEQ ID NO: 1034 - DNA, 63 bp, Artificial Sequence
  Synthetic oligonucleotide
gcacggtagagttcatgtatgcacgtacctcccctttcccaagtaaatgtacgggaattatcg

SEQ ID NO: 1035 - DNA, 67 bp, Artificial Sequence
  Synthetic oligonucleotide
gagacagggcacggtagagtaaaataatgtgacgctttattatgtgttcgtctaactctgtttctgt

SEQ ID NO: 1036 - DNA, 57 bp, Artificial Sequence
  Synthetic oligonucleotide
aaagtgcgcctgatgcacgtacccgagtgcatgagctgtctttcacatgatacatcg

SEQ ID NO: 1037 - DNA, 61 bp, Artificial Sequence
  Synthetic oligonucleotide
ctcgagaacgatactgtggcacgtacctatttctgttcacggatgaaggcctatatcaatg

SEQ ID NO: 1038 - DNA, 55 bp, Artificial Sequence
  Synthetic oligonucleotide
ccctctcgcatggcacgtacccatccactttcatggaaacaataagagcagggaa

SEQ ID NO: 1039 - DNA, 62 bp, Artificial Sequence
  Synthetic oligonucleotide
gagacagtcacgtcatttcagatggcacacaaactcactactaccaacaacctcaccaaaaa

SEQ ID NO: 1040 - DNA, 78 bp, Artificial Sequence
  Synthetic oligonucleotide
gagacagtcaaccttaatataagcacagtagagttacaagttcctcatgtcctctgttaatccagcctgaatatgcca

SEQ ID NO: 1041 - DNA, 62 bp, Artificial Sequence
  Synthetic oligonucleotide
gcacagtagagtattggtcgcacgtaccagaaatgtcactcccatggtggctgatatagaaa

SEQ ID NO: 1042 - DNA, 58 bp, Artificial Sequence
  Synthetic oligonucleotide
gagacagaggagtgagcacggttcatgtcgaaccttggataggagcgaccgattacgt

SEQ ID NO: 1043 - DNA, 62 bp, Artificial Sequence
  Synthetic oligonucleotide
ggttacatgggctttatcgcacgtactctcaggttgttacttgaagggttcaacacgagctc

SEQ ID NO: 1044 - DNA, 60 bp, Artificial Sequence
  Synthetic oligonucleotide
ggtagagacaacttgcgcacgtactcagaagatcaaaaaacgatccctgtccatcaatac

SEQ ID NO: 1045 - DNA, 65 bp, Artificial Sequence
  Synthetic oligonucleotide
gagacagaataaagcacggtggagacaatgcttaggctaccaaatgaatttaaagccagctgaaa

SEQ ID NO: 1046 - DNA, 65 bp, Artificial Sequence
  Synthetic oligonucleotide
gagacagtaggaaataggcacggtagagttccaatgcttgcagtatgtatcctgatcgtgcgtgc

SEQ ID NO: 1047 - DNA, 53 bp, Artificial Sequence
  Synthetic oligonucleotide
aggtcggtgcgcacgtaccctgcattctcatggaaatgcaatggattcattcc

SEQ ID NO: 1048 - DNA, 54 bp, Artificial Sequence
  Synthetic oligonucleotide
gtgtggtggcgcacgtactcctgttgcagtatcacgtaaatacctacttcgata

SEQ ID NO: 1049 - DNA, 67 bp, Artificial Sequence
  Synthetic oligonucleotide
gagacagaagaaagtaatcggaagtcgggtagctagctgttatggctattgctgaaacagcaaaatt

SEQ ID NO: 1050 - DNA, 65 bp, Artificial Sequence
  Synthetic oligonucleotide
acagtagagtaatatagtccgcgcacgtacccttacgacttcactgcaattgacgattcagttaa

SEQ ID NO: 1051 - DNA, 67 bp, Artificial Sequence
  Synthetic oligonucleotide
gagacagcaaaaaggtggttgtataaagtgcccctcataccaatgtaaagtatagttaacgccctgt

SEQ ID NO: 1052 - DNA, 61 bp, Artificial Sequence
  Synthetic oligonucleotide
gagacaggatggcacagtggagtaagcatctccatgactgcttgagcggctggagaatctg

SEQ ID NO: 1053 - DNA, 58 bp, Artificial Sequence
  Synthetic oligonucleotide
acagtagaggtcaccgcacgtacctttcgccacccatataaaccccacttcgtcctca

SEQ ID NO: 1054 - DNA, 60 bp, Artificial Sequence
  Synthetic oligonucleotide
cggtagaggttctgtacgcacgtaccaaggcagagcaaatgtgacactgtctatcagtac

SEQ ID NO: 1055 - DNA, 53 bp, Artificial Sequence
  Synthetic oligonucleotide
gggaggggacgcacgtaccctacatatataggaaaagggaaggtagaagagct

SEQ ID NO: 1056 - DNA, 66 bp, Artificial Sequence
  Synthetic oligonucleotide
gagacaggaaaatcgcatacgtcttgcatacccttctggaatttcttcctttgattttgccatttt

SEQ ID NO: 1057 - DNA, 59 bp, Artificial Sequence
  Synthetic oligonucleotide
gaggtggatcggtctagcacgtacctcctaaggttgctgatttggttgttggagaccca

SEQ ID NO: 1058 - DNA, 61 bp, Artificial Sequence
  Synthetic oligonucleotide
acggtagagctaagctagcacgtactcaaggcctagcctaaaggttcttgcagagcaacat

SEQ ID NO: 1059 - DNA, 53 bp, Artificial Sequence
  Synthetic oligonucleotide
cggcctgcagcacgtactcctaattagctctaggaaacacaaccccgggattt

SEQ ID NO: 1060 - DNA, 56 bp, Artificial Sequence
  Synthetic oligonucleotide
gaacgcctgaccagcacgtaccttgagttatacggaacttcgcaaaagtattccct

SEQ ID NO: 1061 - DNA, 73 bp, Artificial Sequence
  Synthetic oligonucleotide
gagacagaaatgcacagtagagtaaaatatcttgcctgccatccatcaacaactgctccaacagcctttccat

SEQ ID NO: 1062 - DNA, 62 bp, Artificial Sequence
  Synthetic oligonucleotide
gagacaggcacagtagaggtgaggataccggcacaagcagacaaaatcaacatggtcattta

SEQ ID NO: 1063 - DNA, 60 bp, Artificial Sequence
  Synthetic oligonucleotide
gagacagggcataaagggcacagtacgctcacgtgatctaccctagctgaccgctaatga

SEQ ID NO: 1064 - DNA, 60 bp, Artificial Sequence
  Synthetic oligonucleotide
gagacagtcaaggagcacggtagagctctaacctgcatacatatggcatttagttgttca

SEQ ID NO: 1065 - DNA, 63 bp, Artificial Sequence
  Synthetic oligonucleotide
ggcacggtagagaaatcgcataacgtacccttcttgaagacctatgtaaagaaacgggtcact

SEQ ID NO: 1066 - DNA, 66 bp, Artificial Sequence
  Synthetic oligonucleotide
gagacagaggataaggtcgtgtaataggtggccatacgcatgactacattacaacgggccaggaag

SEQ ID NO: 1067 - DNA, 64 bp, Artificial Sequence
  Synthetic oligonucleotide
gagacagagaagaaagtaagcgttggcaccaggtctcgatctcgtacaaaacgactatgaccat

SEQ ID NO: 1068 - DNA, 60 bp, Artificial Sequence
  Synthetic oligonucleotide
ccggctatgactgcttgaacgtactcatgaacgtgtcgtgttatgcagcggtatgtcgtg

SEQ ID NO: 1069 - DNA, 59 bp, Artificial Sequence
  Synthetic oligonucleotide
gagacagtttggtggcacggtagacgtcgtgtcttagacgactgtgtgtgattctcgag

SEQ ID NO: 1070 - DNA, 58 bp, Artificial Sequence
  Synthetic oligonucleotide
gcgaaatgactgcgcaacgtactccaccgttttgccagttccaccagtaactgtaagg

SEQ ID NO: 1071 - DNA, 61 bp, Artificial Sequence
  Synthetic oligonucleotide
agagtactaccgcctgacaacgtactcgccctggaacaacggttatattctctggcagaac

SEQ ID NO: 1072 - DNA, 38 bp, Artificial Sequence
  Synthetic oligonucleotide
tcggacttgatctacacattgacacattgataccctga

SEQ ID NO: 1073 - DNA, 37 bp, Artificial Sequence
  Synthetic oligonucleotide
cgtttgacttagacggactgccttgatcactgactga

SEQ ID NO: 1074 - DNA, 37 bp, Artificial Sequence
  Synthetic oligonucleotide
gagttctccttaaaatctgaccctgacaacgagtgga

SEQ ID NO: 1075 - DNA, 38 bp, Artificial Sequence
  Synthetic oligonucleotide
atactggaggtcatgattctgatcccgtgatattctga

SEQ ID NO: 1076 - DNA, 38 bp, Artificial Sequence
  Synthetic oligonucleotide
ggatacacgggagtctgcgttgacacattttgatttga

SEQ ID NO: 1077 - DNA, 38 bp, Artificial Sequence
  Synthetic oligonucleotide
gtttgcaattgcttaggatactcaacctgactccatga

SEQ ID NO: 1078 - DNA, 38 bp, Artificial Sequence
  Synthetic oligonucleotide
gcggtatttatgataatgactcgtgaccccaatattga

SEQ ID NO: 1079 - DNA, 38 bp, Artificial Sequence
  Synthetic oligonucleotide
ggtcagctagtaaagtttatccgatgatttgattttga

SEQ ID NO: 1080 - DNA, 37 bp, Artificial Sequence
  Synthetic oligonucleotide
gcaggatagtcatgcaaaatattcaacgataattaga

SEQ ID NO: 1081 - DNA, 38 bp, Artificial Sequence
  Synthetic oligonucleotide
tgtgactataacgcactaagccgattctgacgatatga

SEQ ID NO: 1082 - DNA, 38 bp, Artificial Sequence
  Synthetic oligonucleotide
ttttgtacctgcttcgataaccaacagttaggatttga

SEQ ID NO: 1083 - DNA, 38 bp, Artificial Sequence
  Synthetic oligonucleotide
gactatcaaatgaccccgatcgatacgtaggacactga

SEQ ID NO: 1084 - DNA, 36 bp, Artificial Sequence
  Synthetic oligonucleotide
aactggccgtgtgtgccggtgggataactgttacta

SEQ ID NO: 1085 - DNA, 36 bp, Artificial Sequence
  Synthetic oligonucleotide
gaggactagccgatacttgataatgattatgacgta

SEQ ID NO: 1086 - DNA, 37 bp, Artificial Sequence
  Synthetic oligonucleotide
gtgaatgacacacgtctgaccttggatcgctgattga

SEQ ID NO: 1087 - DNA, 38 bp, Artificial Sequence
  Synthetic oligonucleotide
accgtggacttattgcttatattggacttagagcctga

SEQ ID NO: 1088 - DNA, 36 bp, Artificial Sequence
  Synthetic oligonucleotide
gaggacgtacgccttgatgtttaactggattactga

SEQ ID NO: 1089 - DNA, 36 bp, Artificial Sequence
  Synthetic oligonucleotide
caccccttttgattatccttattgatacttatatga

SEQ ID NO: 1090 - DNA, 38 bp, Artificial Sequence
  Synthetic oligonucleotide
tcccgtgatgtgggaacgtagatctttgactgatttga

SEQ ID NO: 1091 - DNA, 38 bp, Artificial Sequence
  Synthetic oligonucleotide
tcgtaatgcccaataaccaactggttaagtagacctga

SEQ ID NO: 1092 - DNA, 36 bp, Artificial Sequence
  Synthetic oligonucleotide
gcgatcacaatttaccggaccgatctccctagacaa

SEQ ID NO: 1093 - DNA, 36 bp, Artificial Sequence
  Synthetic oligonucleotide
gcgtacggaacggaaccgacacaacctgaataccta

SEQ ID NO: 1094 - DNA, 36 bp, Artificial Sequence
  Synthetic oligonucleotide
gcgtacggaacggaaccgacacaacctgaataccga

SEQ ID NO: 1095 - DNA, 38 bp, Artificial Sequence
  Synthetic oligonucleotide
gcttgaatccacgacgaaattacttaaaataaccctga

SEQ ID NO: 1096 - DNA, 38 bp, Artificial Sequence
  Synthetic oligonucleotide
gccggggcggagcctacgatttatatcgcgattattga

SEQ ID NO: 1097 - DNA, 38 bp, Artificial Sequence
  Synthetic oligonucleotide
aagtgcacactgcctcgatttacatttcggacctatga

SEQ ID NO: 1098 - DNA, 38 bp, Artificial Sequence
  Synthetic oligonucleotide
gcgtactgtgcgcgattccgggatatatattcgattga

SEQ ID NO: 1099 - DNA, 38 bp, Artificial Sequence
  Synthetic oligonucleotide
cacagacgttctcgttgatacccggacccgatatttga

SEQ ID NO: 1100 - DNA, 38 bp, Artificial Sequence
  Synthetic oligonucleotide
tccattttggaacgtcgaattactcggatactaattga

SEQ ID NO: 1101 - DNA, 38 bp, Artificial Sequence
  Synthetic oligonucleotide
actcgacgtaaaactatctgtgactcctaatacattga

SEQ ID NO: 1102 - DNA, 38 bp, Artificial Sequence
  Synthetic oligonucleotide
accgtaacttgctagccttccggatccctccaatctga

SEQ ID NO: 1103 - DNA, 38 bp, Artificial Sequence
  Synthetic oligonucleotide
ttcgtacagatacccccgataccccgccacctgattga

SEQ ID NO: 1104 - DNA, 34 bp, Artificial Sequence
  Synthetic oligonucleotide
atattaatgccttgatccgactccgacctcttga

SEQ ID NO: 1105 - DNA, 38 bp, Artificial Sequence
  Synthetic oligonucleotide
ttgacgcgacgtactattttgatcgtattccaatctga

SEQ ID NO: 1106 - DNA, 38 bp, Artificial Sequence
  Synthetic oligonucleotide
gcgccgccacggtacttaaaaactcggactttacttga

SEQ ID NO: 1107 - DNA, 38 bp, Artificial Sequence
  Synthetic oligonucleotide
cgtagtactgctacatccgaaccgaccataaatactga

SEQ ID NO: 1108 - DNA, 38 bp, Artificial Sequence
  Synthetic oligonucleotide
gaggacgcagttgaccggatttccaccgattatattga

SEQ ID NO: 1109 - DNA, 38 bp, Artificial Sequence
  Synthetic oligonucleotide
gaggactgaaccatctcggaccacccatggatacttga

SEQ ID NO: 1110 - DNA, 38 bp, Artificial Sequence
  Synthetic oligonucleotide
tgcgcgagcaaacgcgactattgaaccttagaacctga

SEQ ID NO: 1111 - DNA, 35 bp, Artificial Sequence
  Synthetic oligonucleotide
gctggtgacccctcttgaccttccttattgatttg

SEQ ID NO: 1112 - DNA, 38 bp, Artificial Sequence
  Synthetic oligonucleotide
gagtacctcaccgctttcgattatcgttctgaccttga

SEQ ID NO: 1113 - DNA, 36 bp, Artificial Sequence
  Synthetic oligonucleotide
agccacttcctgctttgaaccggactccttatataa

SEQ ID NO: 1114 - DNA, 38 bp, Artificial Sequence
  Synthetic oligonucleotide
attgagcgtacgcatctaccggattaccttacttttga

SEQ ID NO: 1115 - DNA, 37 bp, Artificial Sequence
  Synthetic oligonucleotide
gaacttacgttactaacctgactctatcttacattga

SEQ ID NO: 1116 - DNA, 37 bp, Artificial Sequence
  Synthetic oligonucleotide
gcaccactattgtgggaattcctgattttactattga

SEQ ID NO: 1117 - DNA, 37 bp, Artificial Sequence
  Synthetic oligonucleotide
gcgtgcctgcctggctctgactccgattattcattga

SEQ ID NO: 1118 - DNA, 38 bp, Artificial Sequence
  Synthetic oligonucleotide
agttccttactaacacaacttttggatatttaaattga

SEQ ID NO: 1119 - DNA, 37 bp, Artificial Sequence
  Synthetic oligonucleotide
actgccttttcttactgggatacttattgattattga

SEQ ID NO: 1120 - DNA, 38 bp, Artificial Sequence
  Synthetic oligonucleotide
atagtacactacctactgactccctatattatgaatga

SEQ ID NO: 1121 - DNA, 38 bp, Artificial Sequence
  Synthetic oligonucleotide
gcgatacaacccttcatttctgactaccgatatattga

SEQ ID NO: 1122 - DNA, 36 bp, Artificial Sequence
  Synthetic oligonucleotide
gcatctttcttcttaatgatttaccgttctcacata

SEQ ID NO: 1123 - DNA, 36 bp, Artificial Sequence
  Synthetic oligonucleotide
accacgtgttattctctgtatttcactttgtctcaa

SEQ ID NO: 1124 - DNA, 36 bp, Artificial Sequence
  Synthetic oligonucleotide
accgggaacatttctgtcgtttcatttcatcactaa

SEQ ID NO: 1125 - DNA, 36 bp, Artificial Sequence
  Synthetic oligonucleotide
agtttattgctccttcccactattgtctatctcgca

SEQ ID NO: 1126 - DNA, 36 bp, Artificial Sequence
  Synthetic oligonucleotide
tcgcttccttgtacttcctatacccttttcaccaca

SEQ ID NO: 1127 - DNA, 35 bp, Artificial Sequence
  Synthetic oligonucleotide
actaactcgcccactcttctcatttggaacctatc

SEQ ID NO: 1128 - DNA, 36 bp, Artificial Sequence
  Synthetic oligonucleotide
actccccctcagctatcatacatcactcgcatctaa

SEQ ID NO: 1129 - DNA, 38 bp, Artificial Sequence
  Synthetic oligonucleotide
aatatatacgcgctacaaatcttttctcctactgatga

SEQ ID NO: 1130 - DNA, 37 bp, Artificial Sequence
  Synthetic oligonucleotide
actatactcacatcctatttaattattggcttaatga

SEQ ID NO: 1131 - DNA, 38 bp, Artificial Sequence
  Synthetic oligonucleotide
atcgatcctgcctaacctggtaaacaactcatttctga

SEQ ID NO: 1132 - DNA, 35 bp, Artificial Sequence
  Synthetic oligonucleotide
ttagctgcttcccagacccaagctattatttttca

SEQ ID NO: 1133 - DNA, 36 bp, Artificial Sequence
  Synthetic oligonucleotide
tccctgcatcttaacttctatagggtttgcttaaaa

SEQ ID NO: 1134 - DNA, 36 bp, Artificial Sequence
  Synthetic oligonucleotide
gggtcactccgtaaggcctctactccaaattataaa

SEQ ID NO: 1135 - DNA, 36 bp, Artificial Sequence
  Synthetic oligonucleotide
aactgtacggcgcaattttactctcaagtaccaaca

SEQ ID NO: 1136 - DNA, 35 bp, Artificial Sequence
  Synthetic oligonucleotide
tgcggactttattcgcttgatgcctatcctgttat

SEQ ID NO: 1137 - DNA, 36 bp, Artificial Sequence
  Synthetic oligonucleotide
tccgccacatcgggttatacttttgaactagttaaa

SEQ ID NO: 1138 - DNA, 38 bp, Artificial Sequence
  Synthetic oligonucleotide
tgttccttcgagttccatcccaaagagttaattcatga

SEQ ID NO: 1139 - DNA, 35 bp, Artificial Sequence
  Synthetic oligonucleotide
tcctgcgactctacggtatattcctttaatcgaca

SEQ ID NO: 1140 - DNA, 38 bp, Artificial Sequence
  Synthetic oligonucleotide
agtaaaattccggttcatccacactgagctttcaatga

SEQ ID NO: 1141 - DNA, 36 bp, Artificial Sequence
  Synthetic oligonucleotide
ttaactccttgaagtacgtcctaggccccctcacca

SEQ ID NO: 1142 - DNA, 36 bp, Artificial Sequence
  Synthetic oligonucleotide
tggagtactggtgccgaacgtttttgaacgggttga

SEQ ID NO: 1143 - DNA, 38 bp, Artificial Sequence
  Synthetic oligonucleotide
gagtactatagagccaagacctcatttagtcactctga

SEQ ID NO: 1144 - DNA, 36 bp, Artificial Sequence
  Synthetic oligonucleotide
ccgacccataacactttcgcttcaagcatctaggca

SEQ ID NO: 1145 - DNA, 36 bp, Artificial Sequence
  Synthetic oligonucleotide
cgtccgcacccctttttcaccttgttctgctatgca

SEQ ID NO: 1146 - DNA, 35 bp, Artificial Sequence
  Synthetic oligonucleotide
gagcctctgtaacccaatcttcaactgcagggacc

SEQ ID NO: 1147 - DNA, 35 bp, Artificial Sequence
  Synthetic oligonucleotide
gagttctccagctagatattccaatacggaaccga

SEQ ID NO: 1148 - DNA, 38 bp, Artificial Sequence
  Synthetic oligonucleotide
gagtattgcgaagattgggtttatcggttctaacatga

SEQ ID NO: 1149 - DNA, 37 bp, Artificial Sequence
  Synthetic oligonucleotide
aaacgctattacggctgacccggtgactcgggattga

SEQ ID NO: 1150 - DNA, 36 bp, Artificial Sequence
  Synthetic oligonucleotide
accgactccagtttcacgggaatattctcaccggga

SEQ ID NO: 1151 - DNA, 38 bp, Artificial Sequence
  Synthetic oligonucleotide
gttgtcggtttccattagttcgatatcttgccgtgaga

SEQ ID NO: 1152 - DNA, 38 bp, Artificial Sequence
  Synthetic oligonucleotide
atgggaatcacgtagctgtaacgataatccatgggtga

SEQ ID NO: 1153 - DNA, 35 bp, Artificial Sequence
  Synthetic oligonucleotide
aggtactgacgattctttaaagtgactactggtga

SEQ ID NO: 1154 - DNA, 38 bp, Artificial Sequence
  Synthetic oligonucleotide
ggcggtggaagtccgaactgccgagttaaattccctga

SEQ ID NO: 1155 - DNA, 38 bp, Artificial Sequence
  Synthetic oligonucleotide
tatcggtcttacgaaagccggcacgtacgtttctttga

SEQ ID NO: 1156 - DNA, 38 bp, Artificial Sequence
  Synthetic oligonucleotide
tgacggatgataggcatgacctcgtagaccacatctga

SEQ ID NO: 1157 - DNA, 38 bp, Artificial Sequence
  Synthetic oligonucleotide
tttgtaccatccttacaaatgagatcttgttatgttga

SEQ ID NO: 1158 - DNA, 36 bp, Artificial Sequence
  Synthetic oligonucleotide
tacatgcgtactataaaccctattgtttactggtaa

SEQ ID NO: 1159 - DNA, 35 bp, Artificial Sequence
  Synthetic oligonucleotide
gcaagtctagatcttcattcatttgttcatgtttt

SEQ ID NO: 1160 - DNA, 35 bp, Artificial Sequence
  Synthetic oligonucleotide
gagtttgcgggaatcttccccgaacaaggggctaa

SEQ ID NO: 1161 - DNA, 35 bp, Artificial Sequence
  Synthetic oligonucleotide
tagaccgttggaggtccggggttggtgcccgatta

SEQ ID NO: 1162 - DNA, 37 bp, Artificial Sequence
  Synthetic oligonucleotide
acactcatacgagatctgattatacacgcgccttgga

SEQ ID NO: 1163 - DNA, 37 bp, Artificial Sequence
  Synthetic oligonucleotide
gtcgtcgggagaccacttatcttttttccatgccgga

SEQ ID NO: 1164 - DNA, 35 bp, Artificial Sequence
  Synthetic oligonucleotide
tcacctgacgttacactcctccgtacaaacgtgta

SEQ ID NO: 1165 - DNA, 35 bp, Artificial Sequence
  Synthetic oligonucleotide
tcctgattaattcatggtcacaactcccggtttcc

SEQ ID NO: 1166 - DNA, 36 bp, Artificial Sequence
  Synthetic oligonucleotide
tccttttgcccatgattattctcgatgtaaaaacga

SEQ ID NO: 1167 - DNA, 37 bp, Artificial Sequence
  Synthetic oligonucleotide
aacgctaatatctgccgatgggaatcctcgattagga

SEQ ID NO: 1168 - DNA, 37 bp, Artificial Sequence
  Synthetic oligonucleotide
agggtgatatttacgttatcttcgaatttctactgga

SEQ ID NO: 1169 - DNA, 36 bp, Artificial Sequence
  Synthetic oligonucleotide
tctcacttacaaagcgtttaatcaacgcagttctta

SEQ ID NO: 1170 - DNA, 37 bp, Artificial Sequence
  Synthetic oligonucleotide
ccgcaaacttaggggctaataattttcgttatccgga

SEQ ID NO: 1171 - DNA, 37 bp, Artificial Sequence
  Synthetic oligonucleotide
tgccagaaaatcgaatttttatacgtaatggcatgga

SEQ ID NO: 1172 - DNA, 35 bp, Artificial Sequence
  Synthetic oligonucleotide
atcgatcctgacgccgaaaacttgacacgactaaa

SEQ ID NO: 1173 - DNA, 35 bp, Artificial Sequence
  Synthetic oligonucleotide
atgctggtaacttttgcacatcttacttggtaaac

SEQ ID NO: 1174 - DNA, 36 bp, Artificial Sequence
  Synthetic oligonucleotide
gcgattactcagcacccccttacttgtttttaatca

SEQ ID NO: 1175 - DNA, 35 bp, Artificial Sequence
  Synthetic oligonucleotide
actgcgggactatctgaattattggtattataaca

SEQ ID NO: 1176 - DNA, 36 bp, Artificial Sequence
  Synthetic oligonucleotide
gagtactgaaggaactggaaccgagtattcttgtca

SEQ ID NO: 1177 - DNA, 36 bp, Artificial Sequence
  Synthetic oligonucleotide
gagaactgcctggtaatatattcccaaacctggaca

SEQ ID NO: 1178 - DNA, 36 bp, Artificial Sequence
  Synthetic oligonucleotide
gagtgcgtaggtcttacatcctatcgaatatttaca

SEQ ID NO: 1179 - DNA, 36 bp, Artificial Sequence
  Synthetic oligonucleotide
ctcagactttacacaatctttctctccacacaagca

SEQ ID NO: 1180 - DNA, 35 bp, Artificial Sequence
  Synthetic oligonucleotide
gccactttcagaatctcgtgtcacacccatcatca

SEQ ID NO: 1181 - DNA, 36 bp, Artificial Sequence
  Synthetic oligonucleotide
gcgttccccgtggacaatatcactttcttatcgtca

SEQ ID NO: 1182 - DNA, 35 bp, Artificial Sequence
  Synthetic oligonucleotide
tcctggtctacgacttacatctgatccgacccaaa

SEQ ID NO: 1183 - DNA, 36 bp, Artificial Sequence
  Synthetic oligonucleotide
ggaccttatttgttcgacccccgttatcacctgaaa

SEQ ID NO: 1184 - DNA, 35 bp, Artificial Sequence
  Synthetic oligonucleotide
gaggacttttactgatcaaccccacctttcgaaaa

SEQ ID NO: 1185 - DNA, 36 bp, Artificial Sequence
  Synthetic oligonucleotide
gctactacttatccgactactctaaaaacaactaca

SEQ ID NO: 1186 - DNA, 35 bp, Artificial Sequence
  Synthetic oligonucleotide
aactgtcatccgccgactaactcaatctaactcaa

SEQ ID NO: 1187 - DNA, 35 bp, Artificial Sequence
  Synthetic oligonucleotide
aactgtcatccgccgactaactcaatctaactcta

SEQ ID NO: 1188 - DNA, 35 bp, Artificial Sequence
  Synthetic oligonucleotide
aactgtcatccgccgactaactcaatctaactcga

SEQ ID NO: 1189 - DNA, 35 bp, Artificial Sequence
  Synthetic oligonucleotide
tactccggcccaactatatacttctccacaccaac

SEQ ID NO: 1190 - DNA, 35 bp, Artificial Sequence
  Synthetic oligonucleotide
tactccggcccaactatatacttctccacaccatc

SEQ ID NO: 1191 - DNA, 35 bp, Artificial Sequence
  Synthetic oligonucleotide
tactccggcccaactatatacttctccacaccagc

SEQ ID NO: 1192 - DNA, 35 bp, Artificial Sequence
  Synthetic oligonucleotide
tcctacctgcccaatccccttttgattacatatat

SEQ ID NO: 1193 - DNA, 35 bp, Artificial Sequence
  Synthetic oligonucleotide
ccacgctttggggacgctattactatccctttcaa

SEQ ID NO: 1194 - DNA, 35 bp, Artificial Sequence
  Synthetic oligonucleotide
aatgtactgataatcccttttacactggttactat

SEQ ID NO: 1195 - DNA, 35 bp, Artificial Sequence
  Synthetic oligonucleotide
ttagtcgtacttttatctatattgggcctaataaa

SEQ ID NO: 1196 - DNA, 36 bp, Artificial Sequence
  Synthetic oligonucleotide
ttcgccacgttcctaaatattttacttattactaaa

SEQ ID NO: 1197 - DNA, 36 bp, Artificial Sequence
  Synthetic oligonucleotide
ttccatgactctgcctatacttattatatctcataa

SEQ ID NO: 1198 - DNA, 36 bp, Artificial Sequence
  Synthetic oligonucleotide
ttggagctacaatcaaacttcatatctctttctaaa

SEQ ID NO: 1199 - DNA, 36 bp, Artificial Sequence
  Synthetic oligonucleotide
tgcccaaaactgcctttagaaacttattacattcaa

SEQ ID NO: 1200 - DNA, 36 bp, Artificial Sequence
  Synthetic oligonucleotide
tctgcgatcgccatttatctcgaccctttacctaaa

SEQ ID NO: 1201 - DNA, 35 bp, Artificial Sequence
  Synthetic oligonucleotide
aacttttttgcactaacctggacctcatatataat

SEQ ID NO: 1202 - DNA, 34 bp, Artificial Sequence
  Synthetic oligonucleotide
aaccgcttttcacactaccactcacgctctcata

SEQ ID NO: 1203 - DNA, 36 bp, Artificial Sequence
  Synthetic oligonucleotide
ccgccgtacccacgctccaattattctcatcctaca

SEQ ID NO: 1204 - DNA, 36 bp, Artificial Sequence
  Synthetic oligonucleotide
tatctccgtccaacacatctctggtcaccacctcca

SEQ ID NO: 1205 - DNA, 35 bp, Artificial Sequence
  Synthetic oligonucleotide
tttctccgctcatcataactgacgccatccactca

SEQ ID NO: 1206 - DNA, 35 bp, Artificial Sequence
  Synthetic oligonucleotide
acttcgctcattcacttgccaactcctgcacaatc

SEQ ID NO: 1207 - DNA, 37 bp, Artificial Sequence
  Synthetic oligonucleotide
tccctcaccgttgcccttattccgtactcacttatga

SEQ ID NO: 1208 - DNA, 36 bp, Artificial Sequence
  Synthetic oligonucleotide
gtgcttctccttttgactcgcctcactcttggtcca

SEQ ID NO: 1209 - DNA, 36 bp, Artificial Sequence
  Synthetic oligonucleotide
ttttctcctcactccgctccgtgccttgacatcaaa

SEQ ID NO: 1210 - DNA, 37 bp, Artificial Sequence
  Synthetic oligonucleotide
taccttcttcaatatccgtccgcttaacctggattca

SEQ ID NO: 1211 - DNA, 36 bp, Artificial Sequence
  Synthetic oligonucleotide
cctcctctgcctaaatacgttttctccaccatcata

SEQ ID NO: 1212 - DNA, 36 bp, Artificial Sequence
  Synthetic oligonucleotide
acttttttaaattttgttcccacgtatccttaatta

SEQ ID NO: 1213 - DNA, 38 bp, Artificial Sequence
  Synthetic oligonucleotide
ttttccgggtttcttctccagtaggttgacttttatga

SEQ ID NO: 1214 - DNA, 35 bp, Artificial Sequence
  Synthetic oligonucleotide
tgttttggcctccacggtttagtacttattttttt

SEQ ID NO: 1215 - DNA, 35 bp, Artificial Sequence
  Synthetic oligonucleotide
gacttttttgctcatattttcaccaatcaattcca

SEQ ID NO: 1216 - DNA, 36 bp, Artificial Sequence
  Synthetic oligonucleotide
tgagttctcttttatattggtcgccactttttccaa

SEQ ID NO: 1217 - DNA, 36 bp, Artificial Sequence
  Synthetic oligonucleotide
ttccttcacttgggctttcaaatcatttataaacaa

SEQ ID NO: 1218 - DNA, 38 bp, Artificial Sequence
  Synthetic oligonucleotide
ttcttgacttcagttcgattttgttattcttagtttga

SEQ ID NO: 1219 - DNA, 38 bp, Artificial Sequence
  Synthetic oligonucleotide
gttaattccttgctcgagtttttccgcttattccttga

SEQ ID NO: 1220 - DNA, 37 bp, Artificial Sequence
  Synthetic oligonucleotide
ggtacatttcgtccctaccattggtttattcttttga

SEQ ID NO: 1221 - DNA, 37 bp, Artificial Sequence
  Synthetic oligonucleotide
attatttttcgttctctcacttgttttcgatcattga

SEQ ID NO: 1222 - DNA, 35 bp, Artificial Sequence
  Synthetic oligonucleotide
taattgagcttttgctcctaacggcgagagccgtt

SEQ ID NO: 1223 - DNA, 36 bp, Artificial Sequence
  Synthetic oligonucleotide
tgatatacgcgcgagtagaacatcaaccagtgagaa

SEQ ID NO: 1224 - DNA, 38 bp, Artificial Sequence
  Synthetic oligonucleotide
taagccgagcgcatgtaggttcgttttcacgagagtga

SEQ ID NO: 1225 - DNA, 35 bp, Artificial Sequence
  Synthetic oligonucleotide
atgaacgcgagtgaggacgctttagttaattatgt

SEQ ID NO: 1226 - DNA, 37 bp, Artificial Sequence
  Synthetic oligonucleotide
actcggatagcggggccgggggaggcctacacattga

SEQ ID NO: 1227 - DNA, 38 bp, Artificial Sequence
  Synthetic oligonucleotide
acgcagtccgtaaattgataaccgggaggttcgagtga

SEQ ID NO: 1228 - DNA, 35 bp, Artificial Sequence
  Synthetic oligonucleotide
agtcccacgagagtggttctctctagataagagga

SEQ ID NO: 1229 - DNA, 37 bp, Artificial Sequence
  Synthetic oligonucleotide
gagtaccataacaaggcctgaagaaccttgcaggtga

SEQ ID NO: 1230 - DNA, 38 bp, Artificial Sequence
  Synthetic oligonucleotide
gcggggtgtgaacccgctcgtatgtaacaacggattga

SEQ ID NO: 1231 - DNA, 37 bp, Artificial Sequence
  Synthetic oligonucleotide
gagtacggttacggtgagtaaccatttagacgtaaga

SEQ ID NO: 1232 - DNA, 38 bp, Artificial Sequence
  Synthetic oligonucleotide
tgggatccgcgaggatctgatggggttcttatgtttga

SEQ ID NO: 1233 - DNA, 36 bp, Artificial Sequence
  Synthetic oligonucleotide
gagtacccgggcagggagccagttattatgttttga

SEQ ID NO: 1234 - DNA, 36 bp, Artificial Sequence
  Synthetic oligonucleotide
gagtacctagatatctcaaaagatatttatcgttaa

SEQ ID NO: 1235 - DNA, 35 bp, Artificial Sequence
  Synthetic oligonucleotide
gagtactctgcgcaagtgttgaactttgtagaaat

SEQ ID NO: 1236 - DNA, 36 bp, Artificial Sequence
  Synthetic oligonucleotide
gagtacttcccgcggggttatggaatgaattggata

SEQ ID NO: 1237 - DNA, 38 bp, Artificial Sequence
  Synthetic oligonucleotide
taatgtctcttccgccgtagtacgagcggttccgctga

SEQ ID NO: 1238 - DNA, 38 bp, Artificial Sequence
  Synthetic oligonucleotide
gagtacagccgcccttgtaccgaggccttattaagtga

SEQ ID NO: 1239 - DNA, 38 bp, Artificial Sequence
  Synthetic oligonucleotide
ttagtttaccgtcaaaggcctcataatgttacaactga

SEQ ID NO: 1240 - DNA, 38 bp, Artificial Sequence
  Synthetic oligonucleotide
cgtagtattgcgggctcgtctcattgcattcctattga

SEQ ID NO: 1241 - DNA, 38 bp, Artificial Sequence
  Synthetic oligonucleotide
cgtgagacgtggttgcccaccacagtgaataaatttga

SEQ ID NO: 1242 - DNA, 37 bp, Artificial Sequence
  Synthetic oligonucleotide
gctccactatttaaccgtgagttgttaaccgggggga

SEQ ID NO: 1243 - DNA, 37 bp, Artificial Sequence
  Synthetic oligonucleotide
gctccagtaccgctgtacgaattatttaagaaaacga

SEQ ID NO: 1244 - DNA, 36 bp, Artificial Sequence
  Synthetic oligonucleotide
gcccacatttttttcgagtgtgtaaggggtgagaaa

SEQ ID NO: 1245 - DNA, 37 bp, Artificial Sequence
  Synthetic oligonucleotide
gcttattccggatgttgcctgcaattaggggactcga

SEQ ID NO: 1246 - DNA, 37 bp, Artificial Sequence
  Synthetic oligonucleotide
gcttgtctcgcggttttgaaagtaatctttaacgaga

SEQ ID NO: 1247 - DNA, 35 bp, Artificial Sequence
  Synthetic oligonucleotide
gcgcgaaagctcaaataaaactaaagtacaacaaa

SEQ ID NO: 1248 - DNA, 36 bp, Artificial Sequence
  Synthetic oligonucleotide
gctaagctgggagaaaatcacaccctcgatcgtaaa

SEQ ID NO: 1249 - DNA, 37 bp, Artificial Sequence
  Synthetic oligonucleotide
ctcacattagggctcggtaaatataacgatctgacga

SEQ ID NO: 1250 - DNA, 35 bp, Artificial Sequence
  Synthetic oligonucleotide
actgtagctattatgaaagtctgggttattggcct

SEQ ID NO: 1251 - DNA, 35 bp, Artificial Sequence
  Synthetic oligonucleotide
aatcgtatggagcgttgaacaaatgaacccgtagt

SEQ ID NO: 1252 - DNA, 38 bp, Artificial Sequence
  Synthetic oligonucleotide
agatatacttgaaaggtggtattatgaatgttgggtga

SEQ ID NO: 1253 - DNA, 38 bp, Artificial Sequence
  Synthetic oligonucleotide
atggtgactcaattaaaatgtgaggtgggggagctaga

SEQ ID NO: 1254 - DNA, 37 bp, Artificial Sequence
  Synthetic oligonucleotide
tcgtggagggtattgaccttctaatgatgggggggga

SEQ ID NO: 1255 - DNA, 38 bp, Artificial Sequence
  Synthetic oligonucleotide
ggttcctatgaaggacacggggggggaggtatcaatga

SEQ ID NO: 1256 - DNA, 37 bp, Artificial Sequence
  Synthetic oligonucleotide
aaggggcggtagactttaggggctgaatggggtggga

SEQ ID NO: 1257 - DNA, 37 bp, Artificial Sequence
  Synthetic oligonucleotide
gagtgcactggatgaattttgaggggggaaggaccga

SEQ ID NO: 1258 - DNA, 37 bp, Artificial Sequence
  Synthetic oligonucleotide
tgcggtgggtggtgggtgggaaataattatgtgggga

SEQ ID NO: 1259 - DNA, 37 bp, Artificial Sequence
  Synthetic oligonucleotide
taccagactggaagtcaatgatcatggttgtctccga

SEQ ID NO: 1260 - DNA, 36 bp, Artificial Sequence
  Synthetic oligonucleotide
aacggtacaacatctgctagagaactgcaacttcta

SEQ ID NO: 1261 - DNA, 36 bp, Artificial Sequence
  Synthetic oligonucleotide
actatatccaatgctatgcgcgcattcagggtagaa

SEQ ID NO: 1262 - DNA, 35 bp, Artificial Sequence
  Synthetic oligonucleotide
agcatcggccgatcgcctcaatcacgttttcgatt

SEQ ID NO: 1263 - DNA, 38 bp, Artificial Sequence
  Synthetic oligonucleotide
aggcttacaatacgttaccccttcttcgtagacggtga

SEQ ID NO: 1264 - DNA, 36 bp, Artificial Sequence
  Synthetic oligonucleotide
cttgacgtcacatttgcctaacactgtaggtcacaa

SEQ ID NO: 1265 - DNA, 35 bp, Artificial Sequence
  Synthetic oligonucleotide
tctggtagcacatgagtttggcattcctctctgca

SEQ ID NO: 1266 - DNA, 35 bp, Artificial Sequence
  Synthetic oligonucleotide
tgttgtccgtatatattccttgtgtgttaattccg

SEQ ID NO: 1267 - DNA, 35 bp, Artificial Sequence
  Synthetic oligonucleotide
gagcactataagtgtgtatctatttgtaactttct

SEQ ID NO: 1268 - DNA, 35 bp, Artificial Sequence
  Synthetic oligonucleotide
tgtggaggcactcttgtatgattgatttcgtatct

SEQ ID NO: 1269 - DNA, 36 bp, Artificial Sequence
  Synthetic oligonucleotide
aatctaacgcatcaaatacgtttgggtagtcattaa

SEQ ID NO: 1270 - DNA, 35 bp, Artificial Sequence
  Synthetic oligonucleotide
tggtcaacgttatcgtatcctactgatcactaact

SEQ ID NO: 1271 - DNA, 36 bp, Artificial Sequence
  Synthetic oligonucleotide
ttgtcgcaccacatcataggtgccacgatgtcccaa

SEQ ID NO: 1272 - DNA, 36 bp, Artificial Sequence
  Synthetic oligonucleotide
actgttacaacagaagggttagatcacatactacaa

SEQ ID NO: 1273 - DNA, 35 bp, Artificial Sequence
  Synthetic oligonucleotide
actcgagggaactaggaactactacaacagtgtgt

SEQ ID NO: 1274 - DNA, 38 bp, Artificial Sequence
  Synthetic oligonucleotide
ccatgaaactacaacatatcaagtcgagtgtggtgtga

SEQ ID NO: 1275 - DNA, 37 bp, Artificial Sequence
  Synthetic oligonucleotide
cggccgacgtagctcaaattctacactatggttgtga

SEQ ID NO: 1276 - DNA, 38 bp, Artificial Sequence
  Synthetic oligonucleotide
ggcagtactatcaacttacatgccaatattcgatgtga

SEQ ID NO: 1277 - DNA, 36 bp, Artificial Sequence
  Synthetic oligonucleotide
gctaccagcgttgcagtctgcggattctgtcaaata

SEQ ID NO: 1278 - DNA, 35 bp, Artificial Sequence
  Synthetic oligonucleotide
cttactcaaagtggcgtgtaggtcattaggttgta

SEQ ID NO: 1279 - DNA, 36 bp, Artificial Sequence
  Synthetic oligonucleotide
cgtagtactagcaacattagggtcgtaacataacta

SEQ ID NO: 1280 - DNA, 36 bp, Artificial Sequence
  Synthetic oligonucleotide
acgaccgtggggttagggcgcatattctttggctta

SEQ ID NO: 1281 - DNA, 37 bp, Artificial Sequence
  Synthetic oligonucleotide
tactctcatgggtatctttctgaatcgaacgttgtga

SEQ ID NO: 1282 - DNA, 35 bp, Artificial Sequence
  Synthetic oligonucleotide
gcggtttaacctcgaaagtaagggcgattaggcga

SEQ ID NO: 1283 - DNA, 35 bp, Artificial Sequence
  Synthetic oligonucleotide
gcgggttcaaattgaggaggaaagacgaaagctct

SEQ ID NO: 1284 - DNA, 38 bp, Artificial Sequence
  Synthetic oligonucleotide
gatcgaatcgatactgcagcggagtgacacgggtctaa

SEQ ID NO: 1285 - DNA, 35 bp, Artificial Sequence
  Synthetic oligonucleotide
tagtccgggtcgttttaaattcagtttggcatttt

SEQ ID NO: 1286 - DNA, 35 bp, Artificial Sequence
  Synthetic oligonucleotide
aaccaggcatagttggccgcaggcaaccccatttt

SEQ ID NO: 1287 - DNA, 35 bp, Artificial Sequence
  Synthetic oligonucleotide
agtccaaacacgaggttccgtcgcgagaactttaa

SEQ ID NO: 1288 - DNA, 37 bp, Artificial Sequence
  Synthetic oligonucleotide
agtccggcaaggggcgcaacttatcatagtcctctga

SEQ ID NO: 1289 - DNA, 35 bp, Artificial Sequence
  Synthetic oligonucleotide
taggctcccgcctttagcttagtttcagatagcaa

SEQ ID NO: 1290 - DNA, 35 bp, Artificial Sequence
  Synthetic oligonucleotide
cgcggtattttgcctcaaactagtcgttaatctat

SEQ ID NO: 1291 - DNA, 37 bp, Artificial Sequence
  Synthetic oligonucleotide
ttacttcgggagctaggctcacccctacattagtgga

SEQ ID NO: 1292 - DNA, 37 bp, Artificial Sequence
  Synthetic oligonucleotide
agtgcaattggatatatcagtgaggagtttcaattga

SEQ ID NO: 1293 - DNA, 37 bp, Artificial Sequence
  Synthetic oligonucleotide
ccgaaatcggggtagattatggggtcctggaaatcga

SEQ ID NO: 1294 - DNA, 38 bp, Artificial Sequence
  Synthetic oligonucleotide
taagtttgtagaatttaacgtatggaacggggacgtga

SEQ ID NO: 1295 - DNA, 35 bp, Artificial Sequence
  Synthetic oligonucleotide
tgagcgagcgcctgatattcggtactgcatatctc

SEQ ID NO: 1296 - DNA, 36 bp, Artificial Sequence
  Synthetic oligonucleotide
gatcgaattaggggaattcgttggaatcgacccata

SEQ ID NO: 1297 - DNA, 38 bp, Artificial Sequence
  Synthetic oligonucleotide
tctgtgcgaagggtttagtctcgggcgaaacttaatga

SEQ ID NO: 1298 - DNA, 38 bp, Artificial Sequence
  Synthetic oligonucleotide
agggaagtcctagttggagtgattttccgtgattctga

SEQ ID NO: 1299 - DNA, 38 bp, Artificial Sequence
  Synthetic oligonucleotide
aggaatggctagtctaagacaaactcctctgtttatga

SEQ ID NO: 1300 - DNA, 37 bp, Artificial Sequence
  Synthetic oligonucleotide
gattgtcacggatgattctggatttatataggtacga

SEQ ID NO: 1301 - DNA, 38 bp, Artificial Sequence
  Synthetic oligonucleotide
attcatgggagcttgaccggagttattgtttgttgtga

SEQ ID NO: 1302 - DNA, 35 bp, Artificial Sequence
  Synthetic oligonucleotide
tatcgaacttagatgtgacactgttttttagtcta

SEQ ID NO: 1303 - DNA, 37 bp, Artificial Sequence
  Synthetic oligonucleotide
agctacggcttatcgttggggtccaagttcatgaaga

SEQ ID NO: 1304 - DNA, 37 bp, Artificial Sequence
  Synthetic oligonucleotide
agtctaccccccaaattgttggtattccgagcataga

SEQ ID NO: 1305 - DNA, 35 bp, Artificial Sequence
  Synthetic oligonucleotide
tcgtcccaagctctggactggtaagttcttatgta

SEQ ID NO: 1306 - DNA, 36 bp, Artificial Sequence
  Synthetic oligonucleotide
tgctacagttcaacctcacgtttttgaactgcgtga

SEQ ID NO: 1307 - DNA, 37 bp, Artificial Sequence
  Synthetic oligonucleotide
cgtttggacgggggtgtccttttttttgatattacga

SEQ ID NO: 1308 - DNA, 37 bp, Artificial Sequence
  Synthetic oligonucleotide
ttcctcgtgttacaggcactttattagcctgtgggga

SEQ ID NO: 1309 - DNA, 36 bp, Artificial Sequence
  Synthetic oligonucleotide
cttggcccgttgaccacgacataatggtcttatata

SEQ ID NO: 1310 - DNA, 36 bp, Artificial Sequence
  Synthetic oligonucleotide
aggatatttaccctgcatcttttcgttacggtatga

SEQ ID NO: 1311 - DNA, 36 bp, Artificial Sequence
  Synthetic oligonucleotide
actgtctggaagtcggaactttcaccattatgatga

SEQ ID NO: 1312 - DNA, 38 bp, Artificial Sequence
  Synthetic oligonucleotide
gaatggaggaactttctcgtattcacgttttgttgtga

SEQ ID NO: 1313 - DNA, 38 bp, Artificial Sequence
  Synthetic oligonucleotide
aaccgttagtgcaaaggggagtacggcctttgttttga

SEQ ID NO: 1314 - DNA, 38 bp, Artificial Sequence
  Synthetic oligonucleotide
ctcgtacgcaaacgctttgaatagaacgtttgtcttga

SEQ ID NO: 1315 - DNA, 37 bp, Artificial Sequence
  Synthetic oligonucleotide
agatacccggtggttatcttaagggtgtgacttttga

SEQ ID NO: 1316 - DNA, 38 bp, Artificial Sequence
  Synthetic oligonucleotide
tagggttcagtatctggcgattctgttgatgttcctga

SEQ ID NO: 1317 - DNA, 38 bp, Artificial Sequence
  Synthetic oligonucleotide
cgagctcccttaagggtgcatcgggattcattgtttga

SEQ ID NO: 1318 - DNA, 38 bp, Artificial Sequence
  Synthetic oligonucleotide
cacatccggagaaggtgcgtttatacatgaatttctga

SEQ ID NO: 1319 - DNA, 38 bp, Artificial Sequence
  Synthetic oligonucleotide
aaggacgacgcggaacaatctgtagctatgactcttga

SEQ ID NO: 1320 - DNA, 37 bp, Artificial Sequence
  Synthetic oligonucleotide
acttgttcctgaagtgggtttgacttgcaaacgttga

SEQ ID NO: 1321 - DNA, 37 bp, Artificial Sequence
  Synthetic oligonucleotide
agtacacgcccgttggtttcgttcggaaattacttga

SEQ ID NO: 1322 - DNA, 37 bp, Artificial Sequence
  Synthetic oligonucleotide
tgaacatctttgttattcaacgggatcacgcaacgga

SEQ ID NO: 1323 - DNA, 36 bp, Artificial Sequence
  Synthetic oligonucleotide
taatccgatgcaatttgtatttactgacaatgcgta

SEQ ID NO: 1324 - DNA, 36 bp, Artificial Sequence
  Synthetic oligonucleotide
aactggaggatcccggaatttatcctcccatacgaa

SEQ ID NO: 1325 - DNA, 37 bp, Artificial Sequence
  Synthetic oligonucleotide
gaattgcggactgacagatagatgcggtgacattgga

SEQ ID NO: 1326 - DNA, 35 bp, Artificial Sequence
  Synthetic oligonucleotide
tcgcactagttctatgagggaaactacaggaacga

SEQ ID NO: 1327 - DNA, 37 bp, Artificial Sequence
  Synthetic oligonucleotide
gattgacctggaaggcaatagctggtcaacgactgga

SEQ ID NO: 1328 - DNA, 37 bp, Artificial Sequence
  Synthetic oligonucleotide
gcagtacggcacgagggatactctgccctatatatga

SEQ ID NO: 1329 - DNA, 37 bp, Artificial Sequence
  Synthetic oligonucleotide
gccatcatggatatatgcacgtatggtgcttttagga

SEQ ID NO: 1330 - DNA, 38 bp, Artificial Sequence
  Synthetic oligonucleotide
tgcgaaactctagatgattatgattaaacttgtactga

SEQ ID NO: 1331 - DNA, 37 bp, Artificial Sequence
  Synthetic oligonucleotide
aactgaccccattgggtcacccgtgatagttatcgga

SEQ ID NO: 1332 - DNA, 38 bp, Artificial Sequence
  Synthetic oligonucleotide
gtactgctctaggagaaaataaccgtatgaaacgatga

SEQ ID NO: 1333 - DNA, 38 bp, Artificial Sequence
  Synthetic oligonucleotide
ttgcgtatttgccttagaacgcaataaagcatttgtga

SEQ ID NO: 1334 - DNA, 38 bp, Artificial Sequence
  Synthetic oligonucleotide
atctacactggaactgacagggggtagtagtatcctga

SEQ ID NO: 1335 - DNA, 38 bp, Artificial Sequence
  Synthetic oligonucleotide
tagggattgaatctcctctaacattcgacaacaggtga

SEQ ID NO: 1336 - DNA, 38 bp, Artificial Sequence
  Synthetic oligonucleotide
agcgttcaacgcggttgagtgggtgccgaactatatga

SEQ ID NO: 1337 - DNA, 38 bp, Artificial Sequence
  Synthetic oligonucleotide
ggacctgatgccatttagtgtggataatgttattgtga

SEQ ID NO: 1338 - DNA, 35 bp, Artificial Sequence
  Synthetic oligonucleotide
tgatatctaggaaccatgcggtaatggtccgagta

SEQ ID NO: 1339 - DNA, 37 bp, Artificial Sequence
  Synthetic oligonucleotide
tgaaagccgtgactggtattaacggcaaataacggga

SEQ ID NO: 1340 - DNA, 36 bp, Artificial Sequence
  Synthetic oligonucleotide
tgcatgatacgggcttcaaggagcttcttattcgta

SEQ ID NO: 1341 - DNA, 37 bp, Artificial Sequence
  Synthetic oligonucleotide
agacacattgtgtgcaacatggaagtggtctttagga

SEQ ID NO: 1342 - DNA, 38 bp, Artificial Sequence
  Synthetic oligonucleotide
gagttgctctatgtacttcctgagggggtatgtgatga

SEQ ID NO: 1343 - DNA, 37 bp, Artificial Sequence
  Synthetic oligonucleotide
cctgttatctatacttgcgtgagcaaattactttaga

SEQ ID NO: 1344 - DNA, 38 bp, Artificial Sequence
  Synthetic oligonucleotide
tggagtacgcgtgcgttacagtccgaataaggctttga

SEQ ID NO: 1345 - DNA, 38 bp, Artificial Sequence
  Synthetic oligonucleotide
cacagtcaggcgtaatgagaatgagcactttggtttga

SEQ ID NO: 1346 - DNA, 36 bp, Artificial Sequence
  Synthetic oligonucleotide
tcatttacgtgagtaacctggcttagtatcggagta

SEQ ID NO: 1347 - DNA, 38 bp, Artificial Sequence
  Synthetic oligonucleotide
gatggaacgtagcgaaaccgggtttacgcgtgatctga

SEQ ID NO: 1348 - DNA, 37 bp, Artificial Sequence
  Synthetic oligonucleotide
taattatcgtcgtgagatcgatactacggttgtgcga

SEQ ID NO: 1349 - DNA, 35 bp, Artificial Sequence
  Synthetic oligonucleotide
gaggactggcattaccgtggtcagctaaactagac

SEQ ID NO: 1350 - DNA, 37 bp, Artificial Sequence
  Synthetic oligonucleotide
tgcagcatacctaattgttcaccgttgggaaaggtga

SEQ ID NO: 1351 - DNA, 36 bp, Artificial Sequence
  Synthetic oligonucleotide
agctttgtaatacgtgagtttgggtaggtcatcgta

SEQ ID NO: 1352 - DNA, 35 bp, Artificial Sequence
  Synthetic oligonucleotide
cctgcgtcctaaacggataacgaaaacgaatactc

SEQ ID NO: 1353 - DNA, 35 bp, Artificial Sequence
  Synthetic oligonucleotide
ccctgcacgaacgaaccggaataaatcgatggtga

SEQ ID NO: 1354 - DNA, 36 bp, Artificial Sequence
  Synthetic oligonucleotide
gcgcttttctcaaccgacgaccatcgaatagaagaa

SEQ ID NO: 1355 - DNA, 36 bp, Artificial Sequence
  Synthetic oligonucleotide
ttaggctaaggaacgggacccattcgatgaaaatca

SEQ ID NO: 1356 - DNA, 36 bp, Artificial Sequence
  Synthetic oligonucleotide
tcggagtttgcaatccggcaattattagattacaca

SEQ ID NO: 1357 - DNA, 35 bp, Artificial Sequence
  Synthetic oligonucleotide
accggaaatgaaccgtcgcttattccacgaattag

SEQ ID NO: 1358 - DNA, 35 bp, Artificial Sequence
  Synthetic oligonucleotide
gagaattgcggtaaatttcggggcaatatcctctc

SEQ ID NO: 1359 - DNA, 36 bp, Artificial Sequence
  Synthetic oligonucleotide
acgccccgaatgatcggtgggctgtattttacaata

SEQ ID NO: 1360 - DNA, 37 bp, Artificial Sequence
  Synthetic oligonucleotide
gagtagtgggctcacgggggcagtatatcggatacga

SEQ ID NO: 1361 - DNA, 36 bp, Artificial Sequence
  Synthetic oligonucleotide
gagtgcgatggcgtccacggggatttttcggaataa

SEQ ID NO: 1362 - DNA, 36 bp, Artificial Sequence
  Synthetic oligonucleotide
accacgtacaaggaagttaggattcggggaccgtga

SEQ ID NO: 1363 - DNA, 35 bp, Artificial Sequence
  Synthetic oligonucleotide
gaaagctcaagctaatgagaatacgatcatacacc

SEQ ID NO: 1364 - DNA, 36 bp, Artificial Sequence
  Synthetic oligonucleotide
aggacgacgaatttactctaggggtgggctggttaa

SEQ ID NO: 1365 - DNA, 37 bp, Artificial Sequence
  Synthetic oligonucleotide
gtacactggtgtgattgttgtggtggagttggtaaga

SEQ ID NO: 1366 - DNA, 36 bp, Artificial Sequence
  Synthetic oligonucleotide
gggtagtacggggagcactgggctagattgtgacta

SEQ ID NO: 1367 - DNA, 35 bp, Artificial Sequence
  Synthetic oligonucleotide
ggtggaacgggggttgggattgtaagggagtatgt

SEQ ID NO: 1368 - DNA, 37 bp, Artificial Sequence
  Synthetic oligonucleotide
acggtaaaaagggcaatgcttggcgtctatcagacga

SEQ ID NO: 1369 - DNA, 35 bp, Artificial Sequence
  Synthetic oligonucleotide
gtgtggaccggctagtaaaggctgttggggtaatt

SEQ ID NO: 1370 - DNA, 35 bp, Artificial Sequence
  Synthetic oligonucleotide
gcctatcggtggatagtttggtcattcattggagc

SEQ ID NO: 1371 - DNA, 37 bp, Artificial Sequence
  Synthetic oligonucleotide
actctccatgggtggggctcccgaaagaatttctaga

SEQ ID NO: 1372 - DNA, 37 bp, Artificial Sequence
  Synthetic oligonucleotide
ttaaagccatcaaaatctatctaaagttgtagaagga

SEQ ID NO: 1373 - DNA, 37 bp, Artificial Sequence
  Synthetic oligonucleotide
gtctacataatttgtatacggtttaaaatctcgagga

SEQ ID NO: 1374 - DNA, 38 bp, Artificial Sequence
  Synthetic oligonucleotide
tctcggagtagaatccaccagaatcacaggaattctga

SEQ ID NO: 1375 - DNA, 35 bp, Artificial Sequence
  Synthetic oligonucleotide
gaaaggtgccaatcgccggtacacaatttaggaaa

SEQ ID NO: 1376 - DNA, 35 bp, Artificial Sequence
  Synthetic oligonucleotide
cataaacaccttatgaatttatgtagaaatcgaaa

SEQ ID NO: 1377 - DNA, 34 bp, Artificial Sequence
  Synthetic oligonucleotide
gaaccgaagtagtagatttaattatacataatgt

SEQ ID NO: 1378 - DNA, 36 bp, Artificial Sequence
  Synthetic oligonucleotide
gccgcaatacaaacgagaggcttctcccgattaata

SEQ ID NO: 1379 - DNA, 35 bp, Artificial Sequence
  Synthetic oligonucleotide
acctgcggaatatcgtgagaattgaaaaaagcaaa

SEQ ID NO: 1380 - DNA, 38 bp, Artificial Sequence
  Synthetic oligonucleotide
taggcgaatcgaaaaaaagtaatcattatgggttgtga

SEQ ID NO: 1381 - DNA, 37 bp, Artificial Sequence
  Synthetic oligonucleotide
ataccggaccaaggacgccggggtactaaggactcga

SEQ ID NO: 1382 - DNA, 37 bp, Artificial Sequence
  Synthetic oligonucleotide
cgcataatagtcgacgtttttttttgtcggattcgga

SEQ ID NO: 1383 - DNA, 38 bp, Artificial Sequence
  Synthetic oligonucleotide
acaggaaggccaaagtttttccaaggtcgattgcctga

SEQ ID NO: 1384 - DNA, 36 bp, Artificial Sequence
  Synthetic oligonucleotide
gaaatcgtttggtaatttagttcggaacccagggta

SEQ ID NO: 1385 - DNA, 35 bp, Artificial Sequence
  Synthetic oligonucleotide
aaaacgtctcatgcggcctttcgagggcatatctc

SEQ ID NO: 1386 - DNA, 38 bp, Artificial Sequence
  Synthetic oligonucleotide
aaggttcgagaattctcactgcagatcatccgtcatga

SEQ ID NO: 1387 - DNA, 35 bp, Artificial Sequence
  Synthetic oligonucleotide
agtgctctctcttgggggtagtcatccagaatagt

SEQ ID NO: 1388 - DNA, 35 bp, Artificial Sequence
  Synthetic oligonucleotide
taagtcccaatttatttgaagacgttgtaatcgtc

SEQ ID NO: 1389 - DNA, 36 bp, Artificial Sequence
  Synthetic oligonucleotide
aaaacaggctaaaaaggtacatccccattttgctta

SEQ ID NO: 1390 - DNA, 37 bp, Artificial Sequence
  Synthetic oligonucleotide
gtgcgcaaggtttagcgcatacgtagttgaataccga

SEQ ID NO: 1391 - DNA, 37 bp, Artificial Sequence
  Synthetic oligonucleotide
ttccaagtacccaggtttagacctgggacgatagcga

SEQ ID NO: 1392 - DNA, 35 bp, Artificial Sequence
  Synthetic oligonucleotide
tttccaccaaccctgatttgaaaaagacacgcaaa

SEQ ID NO: 1393 - DNA, 35 bp, Artificial Sequence
  Synthetic oligonucleotide
ctccgcccaacgagagttctacgtaaagatcaaac

SEQ ID NO: 1394 - DNA, 37 bp, Artificial Sequence
  Synthetic oligonucleotide
tgtcccgcgcttgacatcatcctaagattaaagaaga

SEQ ID NO: 1395 - DNA, 35 bp, Artificial Sequence
  Synthetic oligonucleotide
attaccgttaatttaaagtacccacgggttgttgg

SEQ ID NO: 1396 - DNA, 37 bp, Artificial Sequence
  Synthetic oligonucleotide
gcatcgtggaaagattctcttataatcaattggggga

SEQ ID NO: 1397 - DNA, 35 bp, Artificial Sequence
  Synthetic oligonucleotide
acacacacggggtagatcacataggcaaacgcttg

SEQ ID NO: 1398 - DNA, 36 bp, Artificial Sequence
  Synthetic oligonucleotide
acaaacgtactaagggcgaagccttttactcgcgca

SEQ ID NO: 1399 - DNA, 38 bp, Artificial Sequence
  Synthetic oligonucleotide
cgtgcaaaccgctgtaagcattcaaaccaactggatga

SEQ ID NO: 1400 - DNA, 35 bp, Artificial Sequence
  Synthetic oligonucleotide
acacaaacacaatctaggagttaaatacagttgga

SEQ ID NO: 1401 - DNA, 35 bp, Artificial Sequence
  Synthetic oligonucleotide
actttcacgatgttgggggggcccaattacagatg

SEQ ID NO: 1402 - DNA, 35 bp, Artificial Sequence
  Synthetic oligonucleotide
acgtttagattaagttcgcttatgaatgtgggatt

SEQ ID NO: 1403 - DNA, 37 bp, Artificial Sequence
  Synthetic oligonucleotide
attgccgttgatgttcgtgattttattaagtggggga

SEQ ID NO: 1404 - DNA, 37 bp, Artificial Sequence
  Synthetic oligonucleotide
gttcttaggcctgttgttaccaggattttcgtgtaga

SEQ ID NO: 1405 - DNA, 36 bp, Artificial Sequence
  Synthetic oligonucleotide
agtccggatacctgtttgtatgcgaaagggaattta

SEQ ID NO: 1406 - DNA, 35 bp, Artificial Sequence
  Synthetic oligonucleotide
gttaatgtcaatctgaaccgacgtgagtattcggc

SEQ ID NO: 1407 - DNA, 37 bp, Artificial Sequence
  Synthetic oligonucleotide
accacggttgggttgcggctaacgtatagccgatgga

SEQ ID NO: 1408 - DNA, 36 bp, Artificial Sequence
  Synthetic oligonucleotide
gtgccttggttgtaattggactttatggctacctaa

SEQ ID NO: 1409 - DNA, 38 bp, Artificial Sequence
  Synthetic oligonucleotide
gatttgcgagtgtgaaacgaattatagcacacgtctga

SEQ ID NO: 1410 - DNA, 35 bp, Artificial Sequence
  Synthetic oligonucleotide
atgctggtgaaccaaactcaagcatgacatttaag

SEQ ID NO: 1411 - DNA, 36 bp, Artificial Sequence
  Synthetic oligonucleotide
cctgcccacgaattgtatatgtaattgcactatcga

SEQ ID NO: 1412 - DNA, 35 bp, Artificial Sequence
  Synthetic oligonucleotide
tctgcaggacttttgattcgtgggttcaacctcat

SEQ ID NO: 1413 - DNA, 37 bp, Artificial Sequence
  Synthetic oligonucleotide
gcacattatgtcacgtagaggcacagtcggtaatcga

SEQ ID NO: 1414 - DNA, 36 bp, Artificial Sequence
  Synthetic oligonucleotide
gggctacgttatcccattcaattcgaattaaatgta

SEQ ID NO: 1415 - DNA, 36 bp, Artificial Sequence
  Synthetic oligonucleotide
acattgccgaattaattcgttgtcgaggaaagacaa

SEQ ID NO: 1416 - DNA, 35 bp, Artificial Sequence
  Synthetic oligonucleotide
cccacgtgttacgggttttatcatgacatcactat

SEQ ID NO: 1417 - DNA, 35 bp, Artificial Sequence
  Synthetic oligonucleotide
catgcacgttttattgtggaaatgtaagcttgggc

SEQ ID NO: 1418 - DNA, 37 bp, Artificial Sequence
  Synthetic oligonucleotide
tgcaagggaaatacgttcctgtgttgtttcgatgaga

SEQ ID NO: 1419 - DNA, 35 bp, Artificial Sequence
  Synthetic oligonucleotide
tgggcagtctctatttgtcattacggttttatgtc

SEQ ID NO: 1420 - DNA, 38 bp, Artificial Sequence
  Synthetic oligonucleotide
agcaggcaacagtatcagccctatttgtcgtaaaatga

SEQ ID NO: 1421 - DNA, 38 bp, Artificial Sequence
  Synthetic oligonucleotide
ggctacgggaaagatgtcacgtctgtttcatttgatga

SEQ ID NO: 1422 - DNA, 35 bp, Artificial Sequence
  Synthetic oligonucleotide
actacgttttaatttcagtaacccatccgatgctc

SEQ ID NO: 1423 - DNA, 36 bp, Artificial Sequence
  Synthetic oligonucleotide
aacaaacgccaaccatatggtaggattcctctttta

SEQ ID NO: 1424 - DNA, 36 bp, Artificial Sequence
  Synthetic oligonucleotide
tgataaccatcggtacctcaccgctcccaactctta

SEQ ID NO: 1425 - DNA, 36 bp, Artificial Sequence
  Synthetic oligonucleotide
cgaaccgacgaaatttccacaccgctttgtatgtta

SEQ ID NO: 1426 - DNA, 35 bp, Artificial Sequence
  Synthetic oligonucleotide
tacctcatgtttgtcactatggaaatcatcccgac

SEQ ID NO: 1427 - DNA, 36 bp, Artificial Sequence
  Synthetic oligonucleotide
agttatttctcgccacataacactctatggaaacta

SEQ ID NO: 1428 - DNA, 36 bp, Artificial Sequence
  Synthetic oligonucleotide
atctcggatttcccgtaggtcactggcacatttcta

SEQ ID NO: 1429 - DNA, 37 bp, Artificial Sequence
  Synthetic oligonucleotide
aattttccgctgggacgaatttctaaccctatttgga

SEQ ID NO: 1430 - DNA, 35 bp, Artificial Sequence
  Synthetic oligonucleotide
gaagcaccgaatcacctggcatggccctttatcta

SEQ ID NO: 1431 - DNA, 35 bp, Artificial Sequence
  Synthetic oligonucleotide
actgccgacgcacaacttgggtggggctctaattt

SEQ ID NO: 1432 - DNA, 35 bp, Artificial Sequence
  Synthetic oligonucleotide
ttcgctgacctcaccggacatatcatttaaagcta

SEQ ID NO: 1433 - DNA, 35 bp, Artificial Sequence
  Synthetic oligonucleotide
tcccttattatgcgaaacaaatatgtagttcttac

SEQ ID NO: 1434 - DNA, 35 bp, Artificial Sequence
  Synthetic oligonucleotide
tctaaaactcacgctaggtggtacaaccgattcta

SEQ ID NO: 1435 - DNA, 36 bp, Artificial Sequence
  Synthetic oligonucleotide
gtagccaacgaagctcgcgtattctatttgccctta

SEQ ID NO: 1436 - DNA, 36 bp, Artificial Sequence
  Synthetic oligonucleotide
acctcaccaagtccttaaggattctgtattcataaa

SEQ ID NO: 1437 - DNA, 35 bp, Artificial Sequence
  Synthetic oligonucleotide
agaatctggctattgatccccacacattgcgaaaa

SEQ ID NO: 1438 - DNA, 35 bp, Artificial Sequence
  Synthetic oligonucleotide
acctaccaatctagatccgcttttatggattgctc

SEQ ID NO: 1439 - DNA, 35 bp, Artificial Sequence
  Synthetic oligonucleotide
gacttctaaacacatggggtgcccgcaacatattt

SEQ ID NO: 1440 - DNA, 38 bp, Artificial Sequence
  Synthetic oligonucleotide
tccagaacgtcagctctccatacgcaattaattcatga

SEQ ID NO: 1441 - DNA, 35 bp, Artificial Sequence
  Synthetic oligonucleotide
gacggccttataaggcactcctcattcatttaata

SEQ ID NO: 1442 - DNA, 38 bp, Artificial Sequence
  Synthetic oligonucleotide
gggacctgcaagcctatcaacgggttatacatttgtga

SEQ ID NO: 1443 - DNA, 36 bp, Artificial Sequence
  Synthetic oligonucleotide
tacacttccatttgatgcgctcaccttgaatctgta

SEQ ID NO: 1444 - DNA, 36 bp, Artificial Sequence
  Synthetic oligonucleotide
aatcgaactcattactttccaatggacctgggagaa

SEQ ID NO: 1445 - DNA, 36 bp, Artificial Sequence
  Synthetic oligonucleotide
agtttacgagttacactacaacggacgaatctttta

SEQ ID NO: 1446 - DNA, 35 bp, Artificial Sequence
  Synthetic oligonucleotide
aacttttctggctttatacacatacggttgccatt

SEQ ID NO: 1447 - DNA, 36 bp, Artificial Sequence
  Synthetic oligonucleotide
agaactgggccttggaatcacacacctaactagtta

SEQ ID NO: 1448 - DNA, 36 bp, Artificial Sequence
  Synthetic oligonucleotide
attcgcactaataacatgttgctccattcaacctaa

SEQ ID NO: 1449 - DNA, 35 bp, Artificial Sequence
  Synthetic oligonucleotide
tatctgctgttttctctggtgccaataactacatc

SEQ ID NO: 1450 - DNA, 37 bp, Artificial Sequence
  Synthetic oligonucleotide
ttgcacataattttctgctttaaccaagcgaacccga

SEQ ID NO: 1451 - DNA, 35 bp, Artificial Sequence
  Synthetic oligonucleotide
taaaattctgaaaatacacgtgtctttcgcattac

SEQ ID NO: 1452 - DNA, 35 bp, Artificial Sequence
  Synthetic oligonucleotide
tcccgaacacatcccccttttaagggctttgctaa

SEQ ID NO: 1453 - DNA, 38 bp, Artificial Sequence
  Synthetic oligonucleotide
aaccacacggggctctcatcgatacttctagtgattga

SEQ ID NO: 1454 - DNA, 35 bp, Artificial Sequence
  Synthetic oligonucleotide
atctagaattccgtttgcgcgagtaacttccctgt

SEQ ID NO: 1455 - DNA, 36 bp, Artificial Sequence
  Synthetic oligonucleotide
cccgcttatcgctagtacctcatttagaattggaaa

SEQ ID NO: 1456 - DNA, 36 bp, Artificial Sequence
  Synthetic oligonucleotide
acctgtaaatttggctcacttttcctttacactgga

SEQ ID NO: 1457 - DNA, 35 bp, Artificial Sequence
  Synthetic oligonucleotide
aatagtatcacacctatctggcttcctgtacccgt

SEQ ID NO: 1458 - DNA, 38 bp, Artificial Sequence
  Synthetic oligonucleotide
acccacccttgagcaccattaaatagtgatttcgctga

SEQ ID NO: 1459 - DNA, 37 bp, Artificial Sequence
  Synthetic oligonucleotide
tcacgaaccctttagctctattttgtttgacgcatga

SEQ ID NO: 1460 - DNA, 37 bp, Artificial Sequence
  Synthetic oligonucleotide
gaggaacgtttctcccctcaacatttaaataaacaga

SEQ ID NO: 1461 - DNA, 35 bp, Artificial Sequence
  Synthetic oligonucleotide
atcctacgcataattctcgaggatctatttcgaaa

SEQ ID NO: 1462 - DNA, 36 bp, Artificial Sequence
  Synthetic oligonucleotide
tgcccgcaattacccctagatccacagcttggttta

SEQ ID NO: 1463 - DNA, 38 bp, Artificial Sequence
  Synthetic oligonucleotide
ggctcttatacaaaacattgggttctcgacctccctga

SEQ ID NO: 1464 - DNA, 36 bp, Artificial Sequence
  Synthetic oligonucleotide
gtgagctgctaatatttatcctgaacttgcttacga

SEQ ID NO: 1465 - DNA, 35 bp, Artificial Sequence
  Synthetic oligonucleotide
agttaccttacaacgaggtttcttgaatggattct

SEQ ID NO: 1466 - DNA, 35 bp, Artificial Sequence
  Synthetic oligonucleotide
ttacaccatccctacgcggtaatagcaactctgtt

SEQ ID NO: 1467 - DNA, 36 bp, Artificial Sequence
  Synthetic oligonucleotide
gcaccacgcacctgtggggattccctaatgtcttta

SEQ ID NO: 1468 - DNA, 35 bp, Artificial Sequence
  Synthetic oligonucleotide
ctatcggactaatacacgtaaaaataactctggtt

SEQ ID NO: 1469 - DNA, 35 bp, Artificial Sequence
  Synthetic oligonucleotide
ggcgtacttatcacaaacggtggaaccacacttct

SEQ ID NO: 1470 - DNA, 37 bp, Artificial Sequence
  Synthetic oligonucleotide
tattcttatccaacccacgaaatcaattgtattttga

SEQ ID NO: 1471 - DNA, 35 bp, Artificial Sequence
  Synthetic oligonucleotide
agatccgaatccgtaactccaaaatatttatgcac

SEQ ID NO: 1472 - DNA, 38 bp, Artificial Sequence
  Synthetic oligonucleotide
actatagaacaatccaccgctttaaatcaactatctta

SEQ ID NO: 1473 - DNA, 35 bp, Artificial Sequence
  Synthetic oligonucleotide
gccgttcttctgcgacgaacacatcctcccttaat

SEQ ID NO: 1474 - DNA, 35 bp, Artificial Sequence
  Synthetic oligonucleotide
gcgcgaggcccgcgggctcatcacttttgttatct

SEQ ID NO: 1475 - DNA, 38 bp, Artificial Sequence
  Synthetic oligonucleotide
tacccctgacaatcctcgcgccgaggcctccatcctga

SEQ ID NO: 1476 - DNA, 36 bp, Artificial Sequence
  Synthetic oligonucleotide
ttcggtctaatttttagcggccaaattttcttatca

SEQ ID NO: 1477 - DNA, 36 bp, Artificial Sequence
  Synthetic oligonucleotide
gattttaaaacccttgcacctgattgtgccaatcca

SEQ ID NO: 1478 - DNA, 35 bp, Artificial Sequence
  Synthetic oligonucleotide
gcgcgaggcccgcgggctcatcacttttgttatat

SEQ ID NO: 1479 - DNA, 35 bp, Artificial Sequence
  Synthetic oligonucleotide
gccgttcttctgcgacgaacacatcctcccttact

SEQ ID NO: 1480 - DNA, 36 bp, Artificial Sequence
  Synthetic oligonucleotide
tgctcggccctattaacacgtgccgtgtcttgttca

SEQ ID NO: 1481 - DNA, 38 bp, Artificial Sequence
  Synthetic oligonucleotide
tcgcgccgaccgtattacaccaactctatggactctaa

SEQ ID NO: 1482 - DNA, 36 bp, Artificial Sequence
  Synthetic oligonucleotide
aacccaattcacatacactctcacccccactaaaca

SEQ ID NO: 1483 - DNA, 35 bp, Artificial Sequence
  Synthetic oligonucleotide
gccgttcttctgcgacgaacacatcctcccttatt

SEQ ID NO: 1484 - DNA, 35 bp, Artificial Sequence
  Synthetic oligonucleotide
gcgcgaggcccgcgggctcatcacttttgttatgt

SEQ ID NO: 1485 - DNA, 38 bp, Artificial Sequence
  Synthetic oligonucleotide
tacccctgacaatcctcgcgccgaggcctccatcctca

SEQ ID NO: 1486 - DNA, 36 bp, Artificial Sequence
  Synthetic oligonucleotide
ttccgcgcaaacgaatgactctttgttgaaaaacga

SEQ ID NO: 1487 - DNA, 36 bp, Artificial Sequence
  Synthetic oligonucleotide
gcgtagtggctgcttggcgtttccgcatactaggca

SEQ ID NO: 1488 - DNA, 37 bp, Artificial Sequence
  Synthetic oligonucleotide
aaacctcggctaaccgccaagggtagtgtcccccgca

SEQ ID NO: 1489 - DNA, 38 bp, Artificial Sequence
  Synthetic oligonucleotide
atgagacgtagcaacactcgagacccttggagcactca

SEQ ID NO: 1490 - DNA, 36 bp, Artificial Sequence
  Synthetic oligonucleotide
agctgccagggttcgggaccttaacggatgtcccaa

SEQ ID NO: 1491 - DNA, 37 bp, Artificial Sequence
  Synthetic oligonucleotide
tcacgagcttccactacgtctatccgcgtagacggaa

SEQ ID NO: 1492 - DNA, 37 bp, Artificial Sequence
  Synthetic oligonucleotide
gatcgacgattcgatcatccaacgtatttacaccaga

SEQ ID NO: 1493 - DNA, 36 bp, Artificial Sequence
  Synthetic oligonucleotide
gcagccggcgaccgggatgtcgtcgggacttgctta

SEQ ID NO: 1494 - DNA, 38 bp, Artificial Sequence
  Synthetic oligonucleotide
atgaaccatggttacacctctaatgtagcctcatgtca

SEQ ID NO: 1495 - DNA, 37 bp, Artificial Sequence
  Synthetic oligonucleotide
ccaccggtacttattattcgccatccacacccagtta

SEQ ID NO: 1496 - DNA, 35 bp, Artificial Sequence
  Synthetic oligonucleotide
tagttacgccactactctgtgggagaaacccgaga

SEQ ID NO: 1497 - DNA, 38 bp, Artificial Sequence
  Synthetic oligonucleotide
atccacccaaaatcgatataagtgcgcccccaatctaa

SEQ ID NO: 1498 - DNA, 35 bp, Artificial Sequence
  Synthetic oligonucleotide
aggggggaaagtcatcgggtggctgtactacttca

SEQ ID NO: 1499 - DNA, 37 bp, Artificial Sequence
  Synthetic oligonucleotide
gggggtcgtactcccgagatttgcgttacggtgaaca

SEQ ID NO: 1500 - DNA, 37 bp, Artificial Sequence
  Synthetic oligonucleotide
gagtatcctctggtcgttcggtacagaaacggtgtaa

SEQ ID NO: 1501 - DNA, 37 bp, Artificial Sequence
  Synthetic oligonucleotide
acatggcctttaaatctacggagtactgttgggggga

SEQ ID NO: 1502 - DNA, 36 bp, Artificial Sequence
  Synthetic oligonucleotide
gcgtagtggctgcttggcgtttccgcatactaggaa

SEQ ID NO: 1503 - DNA, 36 bp, Artificial Sequence
  Synthetic oligonucleotide
tccgataccgaacttcactccgtgggcggggttgaa

SEQ ID NO: 1504 - DNA, 38 bp, Artificial Sequence
  Synthetic oligonucleotide
gcagtgttatttctcttggtttctttgatttcacttaa

SEQ ID NO: 1505 - DNA, 38 bp, Artificial Sequence
  Synthetic oligonucleotide
acatccagatacccttgacttaagattgtgaccactaa

SEQ ID NO: 1506 - DNA, 37 bp, Artificial Sequence
  Synthetic oligonucleotide
acaggttctgcgaccagaaagttaggactaacctaga

SEQ ID NO: 1507 - DNA, 38 bp, Artificial Sequence
  Synthetic oligonucleotide
gcagtgttatttctcttggtttctttgatttcacttca

SEQ ID NO: 1508 - DNA, 37 bp, Artificial Sequence
  Synthetic oligonucleotide
ccgcagttttgttcccgggggaatccggactgaacga

SEQ ID NO: 1509 - DNA, 37 bp, Artificial Sequence
  Synthetic oligonucleotide
aggtccggttcctatggactgcctgaccccgcgaaga

SEQ ID NO: 1510 - DNA, 35 bp, Artificial Sequence
  Synthetic oligonucleotide
ttgtaacgatttgggagtccagagactcgctgttt

SEQ ID NO: 1511 - DNA, 37 bp, Artificial Sequence
  Synthetic oligonucleotide
tttgatttaagtactcccgcgttcctccgaataccca

SEQ ID NO: 1512 - DNA, 38 bp, Artificial Sequence
  Synthetic oligonucleotide
gcagagcgcacgtgtactcaatgggttgttaattttaa

SEQ ID NO: 1513 - DNA, 36 bp, Artificial Sequence
  Synthetic oligonucleotide
gaactctgtattattcctgtcattagccgttggtaa

SEQ ID NO: 1514 - DNA, 38 bp, Artificial Sequence
  Synthetic oligonucleotide
gaggccctaccgtgtattttgataatggatttgtttaa

SEQ ID NO: 1515 - DNA, 38 bp, Artificial Sequence
  Synthetic oligonucleotide
tgtaatcacgggtgcgaactcgagagaatttgtgctaa

SEQ ID NO: 1516 - DNA, 38 bp, Artificial Sequence
  Synthetic oligonucleotide
ggccggtagtccacgctttcgcgagatagtgactgtga

SEQ ID NO: 1517 - DNA, 36 bp, Artificial Sequence
  Synthetic oligonucleotide
aggtcctcagaacttgtgcgtgagcaaagaatgaag

SEQ ID NO: 1518 - DNA, 38 bp, Artificial Sequence
  Synthetic oligonucleotide
gagtatctgggttcgagagcgcatttgcccgctgttga

SEQ ID NO: 1519 - DNA, 35 bp, Artificial Sequence
  Synthetic oligonucleotide
gtattaatcttcgctgtgggagagcgattacgcca

SEQ ID NO: 1520 - DNA, 36 bp, Artificial Sequence
  Synthetic oligonucleotide
tatccttggatcaccgatcgatgcgagaggtagtaa

SEQ ID NO: 1521 - DNA, 38 bp, Artificial Sequence
  Synthetic oligonucleotide
ttttctacgtgacggagagtccagatcgaagacaaaga

SEQ ID NO: 1522 - DNA, 36 bp, Artificial Sequence
  Synthetic oligonucleotide
acaatgcatcgtagcgggtctcggagctcgccttaa

SEQ ID NO: 1523 - DNA, 37 bp, Artificial Sequence
  Synthetic oligonucleotide
tacaaagaacggaagctattcaaaaacacacggagga

SEQ ID NO: 1524 - DNA, 35 bp, Artificial Sequence
  Synthetic oligonucleotide
ggacgaccggatatagtaaagtccccggcttctgt

SEQ ID NO: 1525 - DNA, 37 bp, Artificial Sequence
  Synthetic oligonucleotide
agccatcatgttggcacggtcctttgataccattgga

SEQ ID NO: 1526 - DNA, 36 bp, Artificial Sequence
  Synthetic oligonucleotide
attaccgtcaacgggtcctgggctccatacgaggca

SEQ ID NO: 1527 - DNA, 35 bp, Artificial Sequence
  Synthetic oligonucleotide
ctgctttaggtgtggtcgcactcaaatgtgaatgg

SEQ ID NO: 1528 - DNA, 36 bp, Artificial Sequence
  Synthetic oligonucleotide
gcggggtaagaactcgatgaggtgagtggatttgta

SEQ ID NO: 1529 - DNA, 35 bp, Artificial Sequence
  Synthetic oligonucleotide
aagggattggaacttggatgttttcagttggcgca

SEQ ID NO: 1530 - DNA, 38 bp, Artificial Sequence
  Synthetic oligonucleotide
tgcctcggctagcatcacaatagatggtttgcacttga

SEQ ID NO: 1531 - DNA, 38 bp, Artificial Sequence
  Synthetic oligonucleotide
gagacgaaggcaccttttcgacgcgataagctcgttga

SEQ ID NO: 1532 - DNA, 36 bp, Artificial Sequence
  Synthetic oligonucleotide
accgcgaggtcttttggaacagggcatatgaatcca

SEQ ID NO: 1533 - DNA, 37 bp, Artificial Sequence
  Synthetic oligonucleotide
acgtgaaactaccgagcggtgcttttcgctgtagcga

SEQ ID NO: 1534 - DNA, 37 bp, Artificial Sequence
  Synthetic oligonucleotide
caacgcctgactactgtagagtgaacgctggtggtga

SEQ ID NO: 1535 - DNA, 38 bp, Artificial Sequence
  Synthetic oligonucleotide
gcgaaggtttgggtaaaaggaaatagactttgttgtga

SEQ ID NO: 1536 - DNA, 36 bp, Artificial Sequence
  Synthetic oligonucleotide
acaagtcgctgctcagcttcctagggcagtactcaa

SEQ ID NO: 1537 - DNA, 36 bp, Artificial Sequence
  Synthetic oligonucleotide
aaacgggatctgtcgcgagtacagtgttgcccagta

SEQ ID NO: 1538 - DNA, 36 bp, Artificial Sequence
  Synthetic oligonucleotide
taaaggaacagcgattcgggctgttattttaggtga

SEQ ID NO: 1539 - DNA, 36 bp, Artificial Sequence
  Synthetic oligonucleotide
tgtgggattattgtagttgtagtaaggtgaccggca

SEQ ID NO: 1540 - DNA, 36 bp, Artificial Sequence
  Synthetic oligonucleotide
cgctaaccggaactaggttgcaaagctatggtggta

SEQ ID NO: 1541 - DNA, 36 bp, Artificial Sequence
  Synthetic oligonucleotide
cccttaggttccagtgaagttatgcaacttcatgta

SEQ ID NO: 1542 - DNA, 37 bp, Artificial Sequence
  Synthetic oligonucleotide
ctattccagcttttttgatcccgcttttgagagttga

SEQ ID NO: 1543 - DNA, 38 bp, Artificial Sequence
  Synthetic oligonucleotide
acaggacgtgcgcgctaacgttctattagttgtgctga

SEQ ID NO: 1544 - DNA, 36 bp, Artificial Sequence
  Synthetic oligonucleotide
gagtttcgttttatgtgttggctttatttccctcga

SEQ ID NO: 1545 - DNA, 36 bp, Artificial Sequence
  Synthetic oligonucleotide
tggcgttgtagccacgtccctccgctagtagagaaa

SEQ ID NO: 1546 - DNA, 35 bp, Artificial Sequence
  Synthetic oligonucleotide
tcgtagtactggtcttaatttgttgtagtcctaag

SEQ ID NO: 1547 - DNA, 36 bp, Artificial Sequence
  Synthetic oligonucleotide
tccacacgcggcgagctacgcgactaaaatcacgta

SEQ ID NO: 1548 - DNA, 38 bp, Artificial Sequence
  Synthetic oligonucleotide
tatcaaattcggtcgtagtatttgtcgccgtaacgtga

SEQ ID NO: 1549 - DNA, 36 bp, Artificial Sequence
  Synthetic oligonucleotide
gctacgaagtccaaacgtacgcacctgtttggagta

SEQ ID NO: 1550 - DNA, 35 bp, Artificial Sequence
  Synthetic oligonucleotide
tccgggcaccatatctccactgtgcgaatcactat

SEQ ID NO: 1551 - DNA, 35 bp, Artificial Sequence
  Synthetic oligonucleotide
tccgggcaccatatctccactgtgcgaatcactct

SEQ ID NO: 1552 - DNA, 38 bp, Artificial Sequence; identical to SEQ ID NO: 1543
  Synthetic oligonucleotide

SEQ ID NO: 1553 - DNA, 36 bp, Artificial Sequence
  Synthetic oligonucleotide
agcaaacgatgggccatcattcacgcttggtattaa

SEQ ID NO: 1554 - DNA, 38 bp, Artificial Sequence
  Synthetic oligonucleotide
agggacgtgatatttcaatgctgaatatacacacctga

SEQ ID NO: 1555 - DNA, 37 bp, Artificial Sequence
  Synthetic oligonucleotide
agtgattctcacttgttcccggggttcaaagatctga

SEQ ID NO: 1556 - DNA, 36 bp, Artificial Sequence
  Synthetic oligonucleotide
atcaagggaggatttttcggtcggcctagggacaca

SEQ ID NO: 1557 - DNA, 35 bp, Artificial Sequence
  Synthetic oligonucleotide
atacgcggcctaataataagatcgtcataccccaa

SEQ ID NO: 1558 - DNA, 35 bp, Artificial Sequence
  Synthetic oligonucleotide
atctcacgataaagctaacggtgagagtatctact

SEQ ID NO: 1559 - DNA, 37 bp, Artificial Sequence
  Synthetic oligonucleotide
ccgccggcgatgggggatcgcttattttattgttcga

SEQ ID NO: 1560 - DNA, 36 bp, Artificial Sequence
  Synthetic oligonucleotide
cgggtacgttggatcgacaccgaccatcttgacgta

SEQ ID NO: 1561 - DNA, 36 bp, Artificial Sequence; identical to SEQ ID NO: 1540
  Synthetic oligonucleotide

SEQ ID NO: 1562 - DNA, 38 bp, Artificial Sequence
  Synthetic oligonucleotide
cgagtgctgcgcgggttccttggggtgctccaatttga

SEQ ID NO: 1563 - DNA, 35 bp, Artificial Sequence
  Synthetic oligonucleotide
cgtgtaacccgcccaattccatcgtcacgaaattt

SEQ ID NO: 1564 - DNA, 37 bp, Artificial Sequence; identical to SEQ ID NO: 1542
  Synthetic oligonucleotide

SEQ ID NO: 1565 - DNA, 38 bp, Artificial Sequence
  Synthetic oligonucleotide
cctcgaacctgcgcgggagaaggcgcttgctaatctga

SEQ ID NO: 1566 - DNA, 38 bp, Artificial Sequence
  Synthetic oligonucleotide
cttggtccctgctcggttgaatgacgcaatgagtgtga

SEQ ID NO: 1567 - DNA, 38 bp, Artificial Sequence
  Synthetic oligonucleotide
ctcgtaggactgaggtcgatagttatttcacaccgtga

SEQ ID NO: 1568 - DNA, 38 bp, Artificial Sequence
  Synthetic oligonucleotide
gacacgacgtatctccttattccctgctataagtttga

SEQ ID NO: 1569 - DNA, 36 bp, Artificial Sequence
  Synthetic oligonucleotide
gacgttcttgcaccgcgaggtctgcagcaattctaa

SEQ ID NO: 1570 - DNA, 35 bp, Artificial Sequence
  Synthetic oligonucleotide
gcaactattgggccgtattcgtccacggggcttgt

SEQ ID NO: 1571 - DNA, 38 bp, Artificial Sequence
  Synthetic oligonucleotide
gcgtagggttggttatgcatcaattttccgctaattga

SEQ ID NO: 1572 - DNA, 36 bp, Artificial Sequence
  Synthetic oligonucleotide
gccttcggggtttattaagttattacggatctagta

SEQ ID NO: 1573 - DNA, 37 bp, Artificial Sequence
  Synthetic oligonucleotide
gcgcgtgagctgcaccgacatcacgccgattctctga

SEQ ID NO: 1574 - DNA, 36 bp, Artificial Sequence; identical to SEQ ID NO: 1549
  Synthetic oligonucleotide

SEQ ID NO: 1575 - DNA, 36 bp, Artificial Sequence
  Synthetic oligonucleotide
ggtcactcgtaggtctcccgcatcgagaaagccgta

SEQ ID NO: 1576 - DNA, 38 bp, Artificial Sequence
  Synthetic oligonucleotide
gtggatggcactaatatccccttctcgttaaagtgtga

SEQ ID NO: 1577 - DNA, 35 bp, Artificial Sequence
  Synthetic oligonucleotide
gtccaccgggattcgtatgggtatttttacccacc

SEQ ID NO: 1578 - DNA, 38 bp, Artificial Sequence
  Synthetic oligonucleotide
gttacggtatgcgaggtctcacgttgcgatcattttga

SEQ ID NO: 1579 - DNA, 37 bp, Artificial Sequence
  Synthetic oligonucleotide
gttcatcgttcctatgtcactatttccctactgctga

SEQ ID NO: 1580 - DNA, 37 bp, Artificial Sequence
  Synthetic oligonucleotide
tactaggggccgtgagccttgtgccccaagtagccga

SEQ ID NO: 1581 - DNA, 38 bp, Artificial Sequence; identical to SEQ ID NO: 1548
  Synthetic oligonucleotide

SEQ ID NO: 1582 - DNA, 36 bp, Artificial Sequence; identical to SEQ ID NO: 1547
  Synthetic oligonucleotide

SEQ ID NO: 1583 - DNA, 35 bp, Artificial Sequence; identical to SEQ ID NO: 1546
  Synthetic oligonucleotide

SEQ ID NO: 1584 - DNA, 37 bp, Artificial Sequence
  Synthetic oligonucleotide
tcgtgcgctcggttctacgccactgtacgagacacga

SEQ ID NO: 1585 - DNA, 35 bp, Artificial Sequence
  Synthetic oligonucleotide
tgtacgaaccgggcctaggatagttgctacatgta

SEQ ID NO: 1586 - DNA, 36 bp, Artificial Sequence
  Synthetic oligonucleotide
ataatgccagatctttggtttatcttgcgcttggta

SEQ ID NO: 1587 - DNA, 37 bp, Artificial Sequence
  Synthetic oligonucleotide
ccattagctgagtttcggtggacgcatgatagtttga

SEQ ID NO: 1588 - DNA, 35 bp, Artificial Sequence
  Synthetic oligonucleotide
actccatgggccccccggtttggaccccgggttta

SEQ ID NO: 1589 - DNA, 36 bp, Artificial Sequence
  Synthetic oligonucleotide
gaaaatctggcgacttagttttcgtttgatccctta

SEQ ID NO: 1590 - DNA, 36 bp, Artificial Sequence
  Synthetic oligonucleotide
agctcatggacgcactggtggcagtgcgactactaa

SEQ ID NO: 1591 - DNA, 35 bp, Artificial Sequence
  Synthetic oligonucleotide
aggataactggtttttatctctgctaattcactcg

SEQ ID NO: 1592 - DNA, 38 bp, Artificial Sequence
  Synthetic oligonucleotide
cgtggcctgtttggagacgtactgtgtcaggcatttga

SEQ ID NO: 1593 - DNA, 36 bp, Artificial Sequence
  Synthetic oligonucleotide
accttgggatcctgtttagaccgaatcggtgcgcta

SEQ ID NO: 1594 - DNA, 35 bp, Artificial Sequence
  Synthetic oligonucleotide
atcgtagtcatagacccggctttggtttccgggta

SEQ ID NO: 1595 - DNA, 37 bp, Artificial Sequence
  Synthetic oligonucleotide
gacctgggctgtctttactttgtttcgcggggctgga

SEQ ID NO: 1596 - DNA, 38 bp, Artificial Sequence
  Synthetic oligonucleotide
ccttgagccgccgggtttcggtccttattcgtgaatga

SEQ ID NO: 1597 - DNA, 35 bp, Artificial Sequence
  Synthetic oligonucleotide
agatcttttcggttattggggggaaccgagacgta

SEQ ID NO: 1598 - DNA, 36 bp, Artificial Sequence
  Synthetic oligonucleotide
gtgcgttggttaccgatggaggggacccgtagacta

SEQ ID NO: 1599 - DNA, 35 bp, Artificial Sequence
  Synthetic oligonucleotide
ttttattggctcgtttcctataatatgttgaatcc

SEQ ID NO: 1600 - DNA, 35 bp, Artificial Sequence
  Synthetic oligonucleotide
gcctcgacgacagtgacctacatcgctcgtttcgt

SEQ ID NO: 1601 - DNA, 38 bp, Artificial Sequence
  Synthetic oligonucleotide
ggtctggggggattcctacggttccaacagcataatga

SEQ ID NO: 1602 - DNA, 36 bp, Artificial Sequence
  Synthetic oligonucleotide
gttgccttgtaccccatagctggtaaggtcctagta

SEQ ID NO: 1603 - DNA, 36 bp, Artificial Sequence
  Synthetic oligonucleotide
gttgttcgggcgtcgcaacacggtcccattgtctta

SEQ ID NO: 1604 - DNA, 36 bp, Artificial Sequence
  Synthetic oligonucleotide
tcgttatagcctatatacacgcggttgactcgctga

SEQ ID NO: 1605 - DNA, 35 bp, Artificial Sequence
  Synthetic oligonucleotide
ttgtagctgctattgttttctcgattgagaactta

SEQ ID NO: 1606 - DNA, 35 bp, Artificial Sequence
  Synthetic oligonucleotide
ggctcttggtttagcccttattgtttatcattcat

SEQ ID NO: 1607 - DNA, 35 bp, Artificial Sequence
  Synthetic oligonucleotide
taattggcccgtttccaaatttatagattcctaca

SEQ ID NO: 1608 - DNA, 38 bp, Artificial Sequence
  Synthetic oligonucleotide
tccgacccatatcgacgatactggcgtggcgctactga

SEQ ID NO: 1609 - DNA, 38 bp, Artificial Sequence
  Synthetic oligonucleotide
tgcgtgagtaacgcacaggggaacactccgttttgtga

SEQ ID NO: 1610 - DNA, 36 bp, Artificial Sequence
  Synthetic oligonucleotide
gctggtatagctgggtttctatcgtttattctcgta

SEQ ID NO: 1611 - DNA, 36 bp, Artificial Sequence
  Synthetic oligonucleotide
tttgcttcatttgcacttcccccgttattccgctca

SEQ ID NO: 1612 - DNA, 38 bp, Artificial Sequence
  Synthetic oligonucleotide
aatttttactgcgtggaaaggattcgggaatttgttga

SEQ ID NO: 1613 - DNA, 36 bp, Artificial Sequence; identical to SEQ ID NO: 1593
  Synthetic oligonucleotide

SEQ ID NO: 1614 - DNA, 35 bp, Artificial Sequence; identical to SEQ ID NO: 1591
  Synthetic oligonucleotide

SEQ ID NO: 1615 - DNA, 36 bp, Artificial Sequence; identical to SEQ ID NO: 1590
  Synthetic oligonucleotide

SEQ ID NO: 1616 - DNA, 36 bp, Artificial Sequence
  Synthetic oligonucleotide
aggagtacgcgttcatccagacacggaatactttga

SEQ ID NO: 1617 - DNA, 36 bp, Artificial Sequence
  Synthetic oligonucleotide
agccttacgccatgccgagagagcgctttgtttcga

SEQ ID NO: 1618 - DNA, 35 bp, Artificial Sequence
  Synthetic oligonucleotide
agggcttagtttcctgattttactacagctcgctc

SEQ ID NO: 1619 - DNA, 36 bp, Artificial Sequence; identical to SEQ ID NO: 1586
  Synthetic oligonucleotide

SEQ ID NO: 1620 - DNA, 35 bp, Artificial Sequence
  Synthetic oligonucleotide
agtcctgatgctcaatgcgcgagtttcattgagct

SEQ ID NO: 1621 - DNA, 35 bp, Artificial Sequence; identical to SEQ ID NO: 1594
  Synthetic oligonucleotide

SEQ ID NO: 1622 - DNA, 37 bp, Artificial Sequence; identical to SEQ ID NO: 1587
  Synthetic oligonucleotide

SEQ ID NO: 1623 - DNA, 35 bp, Artificial Sequence
  Synthetic oligonucleotide
cgtaagccggtttcagcccacctggagattcttca

SEQ ID NO: 1624 - DNA, 38 bp, Artificial Sequence; identical to SEQ ID NO: 1596
  Synthetic oligonucleotide

SEQ ID NO: 1625 - DNA, 36 bp, Artificial Sequence
  Synthetic oligonucleotide
cgtagttactcgtcatggggtctttgttatgtggta

SEQ ID NO: 1626 - DNA, 36 bp, Artificial Sequence; identical to SEQ ID NO: 1589
  Synthetic oligonucleotide

SEQ ID NO: 1627 - DNA, 37 bp, Artificial Sequence; identical to SEQ ID NO: 1595
  Synthetic oligonucleotide

SEQ ID NO: 1628 - DNA, 37 bp, Artificial Sequence
  Synthetic oligonucleotide
gagtccccttctttgatgctggggtgagctcctccga

SEQ ID NO: 1629 - DNA, 37 bp, Artificial Sequence
  Synthetic oligonucleotide
gatgatcgcgcctttcgtttgtgacggttaccaggga

SEQ ID NO: 1630 - DNA, 35 bp, Artificial Sequence; identical to SEQ ID NO: 1600
  Synthetic oligonucleotide

SEQ ID NO: 1631 - DNA, 38 bp, Artificial Sequence
  Synthetic oligonucleotide
ggcccccgctccctagtttgagcgccctccacgattga

SEQ ID NO: 1632 - DNA, 35 bp, Artificial Sequence; identical to SEQ ID NO: 1606
  Synthetic oligonucleotide

SEQ ID NO: 1633 - DNA, 38 bp, Artificial Sequence; identical to SEQ ID NO: 1601
  Synthetic oligonucleotide

SEQ ID NO: 1634 - DNA, 36 bp, Artificial Sequence; identical to SEQ ID NO: 1602
  Synthetic oligonucleotide

SEQ ID NO: 1635 - DNA, 36 bp, Artificial Sequence; identical to SEQ ID NO: 1603
  Synthetic oligonucleotide

SEQ ID NO: 1636 - DNA, 38 bp, Artificial Sequence
  Synthetic oligonucleotide
tactggggaagctccgggcgcttggtttcgccacctga

SEQ ID NO: 1637 - DNA, 35 bp, Artificial Sequence
  Synthetic oligonucleotide
tcatttcggactgttctaacgcgagttatgaaggg

SEQ ID NO: 1638 - DNA, 36 bp, Artificial Sequence
  Synthetic oligonucleotide
tcacccgacggcaacaagggcatttgcttcatagta

SEQ ID NO: 1639 - DNA, 37 bp, Artificial Sequence
  Synthetic oligonucleotide
tcgaggggaattgtccacatgcatggtttcataagga

SEQ ID NO: 1640 - DNA, 38 bp, Artificial Sequence; identical to SEQ ID NO: 1608
  Synthetic oligonucleotide

SEQ ID NO: 1641 - DNA, 38 bp, Artificial Sequence; identical to SEQ ID NO: 1609
  Synthetic oligonucleotide

SEQ ID NO: 1642 - DNA, 38 bp, Artificial Sequence
  Synthetic oligonucleotide
tgttcttactaggcttagcagcctgttcccgttattga

SEQ ID NO: 1643 - DNA, 37 bp, Artificial Sequence
  Synthetic oligonucleotide
tgttttcagaccagagtaggaattccgagggcggtta

SEQ ID NO: 1644 - DNA, 35 bp, Artificial Sequence
  Synthetic oligonucleotide
tgttttgctgcttagagcgtaatcgtattggctct

SEQ ID NO: 1645 - DNA, 37 bp, Artificial Sequence
  Synthetic oligonucleotide
ttcctaggatgaaacagaaacaccgattggtccagga

SEQ ID NO: 1646 - DNA, 37 bp, Artificial Sequence
  Synthetic oligonucleotide
ttccggttttgggcgactccgtttgcgcccacgctga

SEQ ID NO: 1647 - DNA, 35 bp, Artificial Sequence
  Synthetic oligonucleotide
tttgcaagttcgctacgtatatccactgtgaagcc

SEQ ID NO: 1648 - DNA, 35 bp, Artificial Sequence; identical to SEQ ID NO: 1605
  Synthetic oligonucleotide

SEQ ID NO: 1649 - DNA, 37 bp, Artificial Sequence
  Synthetic oligonucleotide
ttttgttaaacaacgccggcaagggtcgttgttacga

SEQ ID NO: 1650 - DNA, 37 bp, Artificial Sequence
  Synthetic oligonucleotide
ttttcgcattaaaaacgggtgtccaccggttggtgga

SEQ ID NO: 1651 - DNA, 36 bp, Artificial Sequence
  Synthetic oligonucleotide
cgcgcgagcaactacactaacggaaaacccgttcaa

SEQ ID NO: 1652 - DNA, 36 bp, Artificial Sequence
  Synthetic oligonucleotide
ctactcgccgcaacccaacactcagtcaaacgatca

SEQ ID NO: 1653 - DNA, 38 bp, Artificial Sequence
  Synthetic oligonucleotide
ataacgcacgtttccataactcataccactggccttga

SEQ ID NO: 1654 - DNA, 35 bp, Artificial Sequence
  Synthetic oligonucleotide
gagagaagtatttgttaagccacatagttttcttg

SEQ ID NO: 1655 - DNA, 36 bp, Artificial Sequence
  Synthetic oligonucleotide
ccttactgcatggtttggtaccgctattgtccccca

SEQ ID NO: 1656 - DNA, 37 bp, Artificial Sequence
  Synthetic oligonucleotide
aaaattatgcgccttagggaagacatacggcctgtga

SEQ ID NO: 1657 - DNA, 37 bp, Artificial Sequence
  Synthetic oligonucleotide
aatgatcggacttgcaggctcaaccctactgatggga

SEQ ID NO: 1658 - DNA, 35 bp, Artificial Sequence
  Synthetic oligonucleotide
aaggcacgtacacactatcacctggggtgtgcctc

SEQ ID NO: 1659 - DNA, 35 bp, Artificial Sequence
  Synthetic oligonucleotide
aatagattaaagtgaacgtgagtgtttccatatta

SEQ ID NO: 1660 - DNA, 38 bp, Artificial Sequence
  Synthetic oligonucleotide
aattcgtcactcgttgtgtgtagccggtgcccaattga

SEQ ID NO: 1661 - DNA, 36 bp, Artificial Sequence
  Synthetic oligonucleotide
acgggagatcctttaagtacgtcgaagccagcaata

SEQ ID NO: 1662 - DNA, 37 bp, Artificial Sequence
  Synthetic oligonucleotide
actccgttacgtgttggcgctttcagttcagcacgga

SEQ ID NO: 1663 - DNA, 35 bp, Artificial Sequence
  Synthetic oligonucleotide
agacagtggacttctcgtcgaaaatgcatctctat

SEQ ID NO: 1664 - DNA, 37 bp, Artificial Sequence
  Synthetic oligonucleotide
agagaacgttgcccttgagtgtttcttgagccttgga

SEQ ID NO: 1665 - DNA, 36 bp, Artificial Sequence
  Synthetic oligonucleotide
agcgtgtatcatcactgatttagttatcccgagcta

SEQ ID NO: 1666 - DNA, 36 bp, Artificial Sequence
  Synthetic oligonucleotide
agaggccagcttagtgtggccaccgtgagtttacta

SEQ ID NO: 1667 - DNA, 35 bp, Artificial Sequence
  Synthetic oligonucleotide
atatgtatacgaaccctcctaatcgcactatcagt

SEQ ID NO: 1668 - DNA, 38 bp, Artificial Sequence; identical to SEQ ID NO: 1653
  Synthetic oligonucleotide

SEQ ID NO: 1669 - DNA, 36 bp, Artificial Sequence
  Synthetic oligonucleotide
agtacctatcaaggattttgccgaatccgtgccgca

SEQ ID NO: 1670 - DNA, 35 bp, Artificial Sequence
  Synthetic oligonucleotide
agttcactctaacttccgtgccgaaggcgttatcc

SEQ ID NO: 1671 - DNA, 35 bp, Artificial Sequence
  Synthetic oligonucleotide
cacatcgactgcgcgatcaatattagggtggacat

SEQ ID NO: 1672 - DNA, 35 bp, Artificial Sequence
  Synthetic oligonucleotide
attgcattcttcaggacgcttcgcccgggattctt

SEQ ID NO: 1673 - DNA, 35 bp, Artificial Sequence
  Synthetic oligonucleotide
catccctgacgcgagttggaacatgagtacgtact

SEQ ID NO: 1674 - DNA, 36 bp, Artificial Sequence
  Synthetic oligonucleotide
caccgcttagtcttatttagggtcgctaatctggta

SEQ ID NO: 1675 - DNA, 36 bp, Artificial Sequence
  Synthetic oligonucleotide
caaaccgctgcaaaaggatccccgttatggctacat

SEQ ID NO: 1676 - DNA, 38 bp, Artificial Sequence
  Synthetic oligonucleotide
ccggaccattaggtcttcttgttcaaatactttgatga

SEQ ID NO: 1677 - DNA, 36 bp, Artificial Sequence
  Synthetic oligonucleotide
ccgagcttcgtttgggttcatttcgtccgattcgca

SEQ ID NO: 1678 - DNA, 38 bp, Artificial Sequence
  Synthetic oligonucleotide
cctcctattacagttccccgggaatgaatagcaactga

SEQ ID NO: 1679 - DNA, 38 bp, Artificial Sequence
  Synthetic oligonucleotide
cgcctataccgcactcgcttggaacgacacaaagctga

SEQ ID NO: 1680 - DNA, 38 bp, Artificial Sequence
  Synthetic oligonucleotide
cgtggattcgcccacatgatgatggccggtatgtttga

SEQ ID NO: 1681 - DNA, 37 bp, Artificial Sequence
  Synthetic oligonucleotide
ccttttgtaggacgccctttctgcgcatccggtagga

SEQ ID NO: 1682 - DNA, 37 bp, Artificial Sequence
  Synthetic oligonucleotide
ccttaactacacgagagcatgtcaaggggtaaatgga

SEQ ID NO: 1683 - DNA, 36 bp, Artificial Sequence; identical to SEQ ID NO: 1652
  Synthetic oligonucleotide

SEQ ID NO: 1684 - DNA, 38 bp, Artificial Sequence; identical to SEQ ID NO: 1562
  Synthetic oligonucleotide

SEQ ID NO: 1685 - DNA, 36 bp, Artificial Sequence
  Synthetic oligonucleotide
cggagtacgaagccgcttagattacctagcccgtta

SEQ ID NO: 1686 - DNA, 37 bp, Artificial Sequence
  Synthetic oligonucleotide
cgagcgacgtttgtttcaaaaatcactgggaatatga

SEQ ID NO: 1687 - DNA, 35 bp, Artificial Sequence
  Synthetic oligonucleotide
ctacatcgctctccgtaatcgggcgattcatttca

SEQ ID NO: 1688 - DNA, 38 bp, Artificial Sequence
  Synthetic oligonucleotide
gaaaacgttggaagtttttacgccgctctcagccgtga

SEQ ID NO: 1689 - DNA, 35 bp, Artificial Sequence
  Synthetic oligonucleotide
gaatttatgcaatccattaggaaaatgggtgtgcg

SEQ ID NO: 1690 - DNA, 36 bp, Artificial Sequence
  Synthetic oligonucleotide
ctgacagtcttccctggtctattgtccgcagatcga

SEQ ID NO: 1691 - DNA, 38 bp, Artificial Sequence; identical to SEQ ID NO: 1566
  Synthetic oligonucleotide

SEQ ID NO: 1692 - DNA, 36 bp, Artificial Sequence
  Synthetic oligonucleotide
gagggactgcacagcggtgatattctaaatgtacga

SEQ ID NO: 1693 - DNA, 38 bp, Artificial Sequence
  Synthetic oligonucleotide
gaccgggtaggcttctaggcgcccccctccttacttga

SEQ ID NO: 1694 - DNA, 35 bp, Artificial Sequence
  Synthetic oligonucleotide
gaccaaagtatgtgtggtattgatatgccgtgaac

SEQ ID NO: 1695 - DNA, 36 bp, Artificial Sequence
  Synthetic oligonucleotide
gagaaccgtgctcaaggcagaattgtcaccgctcga

SEQ ID NO: 1696 - DNA, 38 bp, Artificial Sequence
  Synthetic oligonucleotide
gacgagtgacttgcactacgaaggccctcgtcgcctga

SEQ ID NO: 1697 - DNA, 37 bp, Artificial Sequence
  Synthetic oligonucleotide
gagtttgtcttgccccgggtcgggacgttgtatccta

SEQ ID NO: 1698 - DNA, 35 bp, Artificial Sequence
  Synthetic oligonucleotide
gagtggcttactttcattggatccgtgagccttgc

SEQ ID NO: 1699 - DNA, 37 bp, Artificial Sequence
  Synthetic oligonucleotide
gcaatacgctagataggcttagaaacggaatacacga

SEQ ID NO: 1700 - DNA, 35 bp, Artificial Sequence
  Synthetic oligonucleotide
gatgtcgtcacggaagtacatatggcgctgtagcc

SEQ ID NO: 1701 - DNA, 35 bp, Artificial Sequence
  Synthetic oligonucleotide
gccactggatttaactgcatcccgtctctgaggct

SEQ ID NO: 1702 - DNA, 35 bp, Artificial Sequence; identical to SEQ ID NO: 1570
  Synthetic oligonucleotide

SEQ ID NO: 1703 - DNA, 37 bp, Artificial Sequence
  Synthetic oligonucleotide
gcaatatgggatatgtgtaactcagtgagacaggaga

SEQ ID NO: 1704 - DNA, 37 bp, Artificial Sequence
  Synthetic oligonucleotide
gattacataactcgtacgtcgcttgttttaagtttga

SEQ ID NO: 1705 - DNA, 37 bp, Artificial Sequence
  Synthetic oligonucleotide
gcgtgctgctttgtactacggtctcatcgttgtagga

SEQ ID NO: 1706 - DNA, 35 bp, Artificial Sequence
  Synthetic oligonucleotide
gccctggcaccaaagtcgcacaatcaatcgtgtgc

SEQ ID NO: 1707 - DNA, 36 bp, Artificial Sequence
  Synthetic oligonucleotide
gccgttggtattctgtcgtcttcctttgttctatca

SEQ ID NO: 1708 - DNA, 37 bp, Artificial Sequence
  Synthetic oligonucleotide
ggcactgtgctgcgatcaggaaaagtcacataccgga

SEQ ID NO: 1709 - DNA, 38 bp, Artificial Sequence
  Synthetic oligonucleotide
ggcccttgaattaacatgatgaatatcacaacgggtga

SEQ ID NO: 1710 - DNA, 36 bp, Artificial Sequence
  Synthetic oligonucleotide
gggtgtttcctgcttatgactacttttctttacgca

SEQ ID NO: 1711 - DNA, 35 bp, Artificial Sequence
  Synthetic oligonucleotide
ggctcgtattttcccagtatcgtttccggtacgtc

SEQ ID NO: 1712 - DNA, 35 bp, Artificial Sequence
  Synthetic oligonucleotide
ggggatctcgggcgatgaagcctagctattgtact

SEQ ID NO: 1713 - DNA, 35 bp, Artificial Sequence
  Synthetic oligonucleotide
ggtcccgtattccagatatactaacggttaccacc

SEQ ID NO: 1714 - DNA, 37 bp, Artificial Sequence
  Synthetic oligonucleotide
gtactgtccgtgtgaacgggtctctgcagaaattcga

SEQ ID NO: 1715 - DNA, 38 bp, Artificial Sequence
  Synthetic oligonucleotide
gtgatcggtactgttgaacttgttgcaccgcccgctga

SEQ ID NO: 1716 - DNA, 38 bp, Artificial Sequence
  Synthetic oligonucleotide
gtgtcacatggggtgaccggattgaggagaggatatga

SEQ ID NO: 1717 - DNA, 37 bp, Artificial Sequence
  Synthetic oligonucleotide
gtgtcctttctgggttgatgcatttacggtttggtga

SEQ ID NO: 1718 - DNA, 37 bp, Artificial Sequence
  Synthetic oligonucleotide
gttcggttggttcccgcgctgaacaatattacctgga

SEQ ID NO: 1719 - DNA, 36 bp, Artificial Sequence
  Synthetic oligonucleotide
gttgggacccgattaacccaacagaattcggaataa

SEQ ID NO: 1720 - DNA, 36 bp, Artificial Sequence
  Synthetic oligonucleotide
tacctgagcgctggagctcgttagtcggaataggaa

SEQ ID NO: 1721 - DNA, 35 bp, Artificial Sequence
  Synthetic oligonucleotide
tacccgttcaccggataggatgttcgtccttaatt

SEQ ID NO: 1722 - DNA, 38 bp, Artificial Sequence
  Synthetic oligonucleotide
taccgatcaacccagcaaggcttgggtggattgaatga

SEQ ID NO: 1723 - DNA, 36 bp, Artificial Sequence
  Synthetic oligonucleotide
tccccccgtcgcttacggtgttggacgggctcatta

SEQ ID NO: 1724 - DNA, 36 bp, Artificial Sequence
  Synthetic oligonucleotide
tcttcataaatgactaacgcttcttagtgatgttga

SEQ ID NO: 1725 - DNA, 36 bp, Artificial Sequence
  Synthetic oligonucleotide
tgccatacctacccagagtgagacttctagcctgga

SEQ ID NO: 1726 - DNA, 38 bp, Artificial Sequence
  Synthetic oligonucleotide
tgaggtcccttttgtcggggtatatccatgaggtttga

SEQ ID NO: 1727 - DNA, 37 bp, Artificial Sequence
  Synthetic oligonucleotide
tggcttggcccgttcgttcgtgatcaagattttttga

SEQ ID NO: 1728 - DNA, 38 bp, Artificial Sequence
  Synthetic oligonucleotide
tggtctgaaattcccgtgaggagatagatcatttctga

SEQ ID NO: 1729 - DNA, 35 bp, Artificial Sequence
  Synthetic oligonucleotide
tgtccaaatcactcattctcgtaaggttaccgtcc

SEQ ID NO: 1730 - DNA, 36 bp, Artificial Sequence
  Synthetic oligonucleotide
tgttctgtcttatgccatgaagttcttataagtaga

SEQ ID NO: 1731 - DNA, 38 bp, Artificial Sequence
  Synthetic oligonucleotide
ttacccctgtaatgccctacatgatgttcggttcatga

SEQ ID NO: 1732 - DNA, 35 bp, Artificial Sequence
  Synthetic oligonucleotide
ttgtaccagtgcgtatgttgtctcatcaatgtttt

SEQ ID NO: 1733 - DNA, 37 bp, Artificial Sequence
  Synthetic oligonucleotide
ttttagcaacgggagttgcagcggggttgttaaacga

SEQ ID NO: 1734 - DNA, 35 bp, Artificial Sequence; identical to SEQ ID NO: 1591
  Synthetic oligonucleotide

SEQ ID NO: 1735 - DNA, 36 bp, Artificial Sequence; identical to SEQ ID NO: 1586
  Synthetic oligonucleotide

SEQ ID NO: 1736 - DNA, 36 bp, Artificial Sequence; identical to SEQ ID NO: 1589
  Synthetic oligonucleotide

SEQ ID NO: 1737 - DNA, 38 bp, Artificial Sequence; identical to SEQ ID NO: 1612
  Synthetic oligonucleotide

SEQ ID NO: 1738 - DNA, 35 bp, Artificial Sequence; identical to SEQ ID NO: 1594
  Synthetic oligonucleotide

SEQ ID NO: 1739 - DNA, 37 bp, Artificial Sequence; identical to SEQ ID NO: 1595
  Synthetic oligonucleotide

SEQ ID NO: 1740 - DNA, 35 bp, Artificial Sequence
  Synthetic oligonucleotide
attccgtgaggtacgtaaggcaaccagttttattt

SEQ ID NO: 1741 - DNA, 36 bp, Artificial Sequence; identical to SEQ ID NO: 1593
  Synthetic oligonucleotide

SEQ ID NO: 1742 - DNA, 37 bp, Artificial Sequence; identical to SEQ ID NO: 1587
  Synthetic oligonucleotide

SEQ ID NO: 1743 - DNA, 38 bp, Artificial Sequence; identical to SEQ ID NO: 1596
  Synthetic oligonucleotide

SEQ ID NO: 1744 - DNA, 35 bp, Artificial Sequence; identical to SEQ ID NO: 1600
  Synthetic oligonucleotide

SEQ ID NO: 1745 - DNA, 35 bp, Artificial Sequence; identical to SEQ ID NO: 1606
  Synthetic oligonucleotide

SEQ ID NO: 1746 - DNA, 38 bp, Artificial Sequence; identical to SEQ ID NO: 1608
  Synthetic oligonucleotide

SEQ ID NO: 1747 - DNA, 38 bp, Artificial Sequence; identical to SEQ ID NO: 1601
  Synthetic oligonucleotide

SEQ ID NO: 1748 - DNA, 35 bp, Artificial Sequence; identical to SEQ ID NO: 1605
  Synthetic oligonucleotide

SEQ ID NO: 1749 - DNA, 36 bp, Artificial Sequence; identical to SEQ ID NO: 1611
  Synthetic oligonucleotide

SEQ ID NO: 1750 - DNA, 36 bp, Artificial Sequence
  Synthetic oligonucleotide
tcttgtcgggattttgctcctttcatactcatggta

SEQ ID NO: 1751 - DNA, 36 bp, Artificial Sequence; identical to SEQ ID NO: 1598
  Synthetic oligonucleotide

SEQ ID NO: 1752 - DNA, 35 bp, Artificial Sequence; identical to SEQ ID NO: 1599
  Synthetic oligonucleotide

SEQ ID NO: 1753 - DNA, 36 bp, Artificial Sequence; identical to SEQ ID NO: 1603
  Synthetic oligonucleotide

SEQ ID NO: 1754 - DNA, 38 bp, Artificial Sequence; identical to SEQ ID NO: 1609
  Synthetic oligonucleotide

SEQ ID NO: 1755 - DNA, 36 bp, Artificial Sequence; identical to SEQ ID NO: 1593
  Synthetic oligonucleotide

SEQ ID NO: 1756 - DNA, 35 bp, Artificial Sequence; identical to SEQ ID NO: 1591
  Synthetic oligonucleotide

SEQ ID NO: 1757 - DNA, 36 bp, Artificial Sequence; identical to SEQ ID NO: 1590
  Synthetic oligonucleotide

SEQ ID NO: 1758 - DNA, 36 bp, Artificial Sequence; identical to SEQ ID NO: 1617
  Synthetic oligonucleotide

SEQ ID NO: 1759 - DNA, 36 bp, Artificial Sequence; identical to SEQ ID NO: 1616
  Synthetic oligonucleotide

SEQ ID NO: 1760 - DNA, 36 bp, Artificial Sequence; identical to SEQ ID NO: 1586
  Synthetic oligonucleotide

SEQ ID NO: 1761 - DNA, 35 bp, Artificial Sequence; identical to SEQ ID NO: 1620
  Synthetic oligonucleotide

SEQ ID NO: 1762 - DNA, 35 bp, Artificial Sequence; identical to SEQ ID NO: 1594
  Synthetic oligonucleotide

SEQ ID NO: 1763 - DNA, 37 bp, Artificial Sequence; identical to SEQ ID NO: 1587
  Synthetic oligonucleotide

SEQ ID NO: 1764 - DNA, 38 bp, Artificial Sequence; identical to SEQ ID NO: 1596
  Synthetic oligonucleotide

SEQ ID NO: 1765 - DNA, 36 bp, Artificial Sequence; identical to SEQ ID NO: 1589
  Synthetic oligonucleotide

SEQ ID NO: 1766 - DNA, 37 bp, Artificial Sequence; identical to SEQ ID NO: 1595
  Synthetic oligonucleotide

SEQ ID NO: 1767 - DNA, 37 bp, Artificial Sequence
  Synthetic oligonucleotide
gagcgactcatcccggggtttggatcagcgctccgga

SEQ ID NO: 1768 - DNA, 37 bp, Artificial Sequence; identical to SEQ ID NO: 1628
  Synthetic oligonucleotide

SEQ ID NO: 1769 - DNA, 36 bp, Artificial Sequence
  Synthetic oligonucleotide
ggtctcttggtttagatcccgtcttttctgtggaaa

SEQ ID NO: 1770 - DNA, 38 bp, Artificial Sequence; identical to SEQ ID NO: 1601
  Synthetic oligonucleotide

SEQ ID NO: 1771 - DNA, 35 bp, Artificial Sequence; identical to SEQ ID NO: 1606
  Synthetic oligonucleotide

SEQ ID NO: 1772 - DNA, 38 bp, Artificial Sequence
  Synthetic oligonucleotide
gtccaggctctatgcttagtacccgttcatttgcttga

SEQ ID NO: 1773 - DNA, 36 bp, Artificial Sequence; identical to SEQ ID NO: 1603
  Synthetic oligonucleotide

SEQ ID NO: 1774 - DNA, 38 bp, Artificial Sequence; identical to SEQ ID NO: 1636
  Synthetic oligonucleotide

SEQ ID NO: 1775 - DNA, 35 bp, Artificial Sequence; identical to SEQ ID NO: 1637
  Synthetic oligonucleotide

SEQ ID NO: 1776 - DNA, 36 bp, Artificial Sequence; identical to SEQ ID NO: 1638
  Synthetic oligonucleotide

SEQ ID NO: 1777 - DNA, 35 bp, Artificial Sequence
  Synthetic oligonucleotide
tcctagaaatctgtattgtttctcaaggccacctg

SEQ ID NO: 1778 - DNA, 37 bp, Artificial Sequence; identical to SEQ ID NO: 1639
  Synthetic oligonucleotide

SEQ ID NO: 1779 - DNA, 36 bp, Artificial Sequence; identical to SEQ ID NO: 1750
  Synthetic oligonucleotide

SEQ ID NO: 1780 - DNA, 38 bp, Artificial Sequence; identical to SEQ ID NO: 1609
  Synthetic oligonucleotide

SEQ ID NO: 1781 - DNA, 35 bp, Artificial Sequence
  Synthetic oligonucleotide
tgttttatctggatcacactagctattgtacggtt

SEQ ID NO: 1782 - DNA, 37 bp, Artificial Sequence; identical to SEQ ID NO: 1643
  Synthetic oligonucleotide

SEQ ID NO: 1783 - DNA, 37 bp, Artificial Sequence; identical to SEQ ID NO: 1645
  Synthetic oligonucleotide

SEQ ID NO: 1784 - DNA, 37 bp, Artificial Sequence; identical to SEQ ID NO: 1646
  Synthetic oligonucleotide

SEQ ID NO: 1785 - DNA, 35 bp, Artificial Sequence; identical to SEQ ID NO: 1647
  Synthetic oligonucleotide

SEQ ID NO: 1786 - DNA, 35 bp, Artificial Sequence; identical to SEQ ID NO: 1605
  Synthetic oligonucleotide

SEQ ID NO: 1787 - DNA, 37 bp, Artificial Sequence
  Synthetic oligonucleotide
tttgagcgcctcagtttgcgcgacttccagcccgtga

SEQ ID NO: 1788 - DNA, 37 bp, Artificial Sequence; identical to SEQ ID NO: 1649
  Synthetic oligonucleotide

SEQ ID NO: 1789 - DNA, 37 bp, Artificial Sequence; identical to SEQ ID NO: 1650
  Synthetic oligonucleotide

SEQ ID NO: 1790 - DNA, 36 bp, Artificial Sequence; identical to SEQ ID NO: 1652
  Synthetic oligonucleotide

SEQ ID NO: 1791 - DNA, 38 bp, Artificial Sequence; identical to SEQ ID NO: 1653
  Synthetic oligonucleotide

SEQ ID NO: 1792 - DNA, 38 bp, Artificial Sequence
  Synthetic oligonucleotide
atgctatcccgtgaaacgagaacatacggtttttttga

SEQ ID NO: 1793 - DNA, 35 bp, Artificial Sequence; identical to SEQ ID NO: 1654
  Synthetic oligonucleotide

SEQ ID NO: 1794 - DNA, 36 bp, Artificial Sequence; identical to SEQ ID NO: 1540
  Synthetic oligonucleotide

SEQ ID NO: 1795 - DNA, 36 bp, Artificial Sequence
  Synthetic oligonucleotide
agggcaatctgtcccgccctcagcttttttatttaa

SEQ ID NO: 1796 - DNA, 37 bp, Artificial Sequence; identical to SEQ ID NO: 1555
  Synthetic oligonucleotide

SEQ ID NO: 1797 - DNA, 38 bp, Artificial Sequence; identical to SEQ ID NO: 1543
  Synthetic oligonucleotide

SEQ ID NO: 1798 - DNA, 38 bp, Artificial Sequence
  Synthetic oligonucleotide
accgaaaacccgttcccgccgtactgcttctatattga

SEQ ID NO: 1799 - DNA, 36 bp, Artificial Sequence; identical to SEQ ID NO: 1549
  Synthetic oligonucleotide

SEQ ID NO: 1800 - DNA, 36 bp, Artificial Sequence; identical to SEQ ID NO: 1547
  Synthetic oligonucleotide

SEQ ID NO: 1801 - DNA, 35 bp, Artificial Sequence; identical to SEQ ID NO: 1550
  Synthetic oligonucleotide

SEQ ID NO: 1802 - DNA, 35 bp, Artificial Sequence; identical to SEQ ID NO: 1551
  Synthetic oligonucleotide

SEQ ID NO: 1803 - DNA, 35 bp, Artificial Sequence; identical to SEQ ID NO: 1546
  Synthetic oligonucleotide

SEQ ID NO: 1804 - DNA, 38 bp, Artificial Sequence
  Synthetic oligonucleotide
tttccgattattatgaccgcttttattattggaggtga

SEQ ID NO: 1805 - DNA, 38 bp, Artificial Sequence
  Synthetic oligonucleotide
tcttggacgtgcgtgatccccattttatatatgattga

SEQ ID NO: 1806 - DNA, 38 bp, Artificial Sequence; identical to SEQ ID NO: 1543
  Synthetic oligonucleotide

SEQ ID NO: 1807 - DNA, 36 bp, Artificial Sequence; identical to SEQ ID NO: 1553
  Synthetic oligonucleotide

SEQ ID NO: 1808 - DNA, 36 bp, Artificial Sequence; identical to SEQ ID NO: 1540
  Synthetic oligonucleotide

SEQ ID NO: 1809 - DNA, 37 bp, Artificial Sequence; identical to SEQ ID NO: 1542
  Synthetic oligonucleotide

SEQ ID NO: 1810 - DNA, 36 bp, Artificial Sequence; identical to SEQ ID NO: 1549
  Synthetic oligonucleotide

SEQ ID NO: 1811 - DNA, 35 bp, Artificial Sequence; identical to SEQ ID NO: 1551
  Synthetic oligonucleotide

SEQ ID NO: 1812 - DNA, 38 bp, Artificial Sequence; identical to SEQ ID NO: 1805
  Synthetic oligonucleotide

SEQ ID NO: 1813 - DNA, 35 bp, Artificial Sequence; identical to SEQ ID NO: 1546
  Synthetic oligonucleotide

SEQ ID NO: 1814 - DNA, 38 bp, Artificial Sequence
  Synthetic oligonucleotide
tgcccttagtttccgtatgaccactttgattcttttga

SEQ ID NO: 1815 - DNA, 38 bp, Artificial Sequence; identical to SEQ ID NO: 1804
  Synthetic oligonucleotide

SEQ ID NO: 1816 - DNA, 38 bp, Artificial Sequence
  Synthetic oligonucleotide
attcgcatagcctatgggaagggaattgtgaggggtga

SEQ ID NO: 1817 - DNA, 38 bp, Artificial Sequence
  Synthetic oligonucleotide
gaggttccctgtgggtcatgtcgcacgatttttagtga

SEQ ID NO: 1818 - DNA, 38 bp, Artificial Sequence; identical to SEQ ID NO: 1543
  Synthetic oligonucleotide

SEQ ID NO: 1819 - DNA, 38 bp, Artificial Sequence; identical to SEQ ID NO: 1548
  Synthetic oligonucleotide

SEQ ID NO: 1820 - DNA, 37 bp, Artificial Sequence
  Synthetic oligonucleotide
tgcccgcttttggtttatatggcttcttatctttcga

SEQ ID NO: 1821 - DNA, 38 bp, Artificial Sequence; identical to SEQ ID NO: 1804
  Synthetic oligonucleotide

SEQ ID NO: 1822 - DNA, 35 bp, Artificial Sequence; identical to SEQ ID NO: 1550
  Synthetic oligonucleotide

SEQ ID NO: 1823 - DNA, 38 bp, Artificial Sequence
  Synthetic oligonucleotide
aaacgtgggggcgtcccagccccatgtgttatctctga

SEQ ID NO: 1824 - DNA, 38 bp, Artificial Sequence
  Synthetic oligonucleotide
aaccctctcccatcctctcgaaacactagattacctga

SEQ ID NO: 1825 - DNA, 35 bp, Artificial Sequence
  Synthetic oligonucleotide
aacatacgtcccaagcgcatctcgattctatcttc

SEQ ID NO: 1826 - DNA, 37 bp, Artificial Sequence
  Synthetic oligonucleotide
aaccacgcctaaatggattcacttcctcaaaaattga

SEQ ID NO: 1827 - DNA, 37 bp, Artificial Sequence
  Synthetic oligonucleotide
aacgccgcacttcgttaaaagtctataaaactctaga

SEQ ID NO: 1828 - DNA, 37 bp, Artificial Sequence
  Synthetic oligonucleotide
aacgaagtattataacccttgtgtatcccgaccatga

SEQ ID NO: 1829 - DNA, 35 bp, Artificial Sequence
  Synthetic oligonucleotide
aacaaagttcacccataccacaaccccaattcgac

SEQ ID NO: 1830 - DNA, 38 bp, Artificial Sequence
  Synthetic oligonucleotide
aacggctgggaggggtagcattttaactatatttctga

SEQ ID NO: 1831 - DNA, 38 bp, Artificial Sequence
  Synthetic oligonucleotide
aagtggtccgtttcggcaataagtacaacgggatctga

SEQ ID NO: 1832 - DNA, 38 bp, Artificial Sequence
  Synthetic oligonucleotide
aactctgcataactaaccgacgccaactattatcctga

SEQ ID NO: 1833 - DNA, 36 bp, Artificial Sequence
  Synthetic oligonucleotide
aatcaggcttgtttgctagacaaaataagcacgaaa

SEQ ID NO: 1834 - DNA, 38 bp, Artificial Sequence
  Synthetic oligonucleotide
aattgcgttttccggttgactaaaaacacggaatctga

SEQ ID NO: 1835 - DNA, 36 bp, Artificial Sequence
  Synthetic oligonucleotide
aataaacacttcgaccaaactaaggccttatctcca

SEQ ID NO: 1836 - DNA, 38 bp, Artificial Sequence
  Synthetic oligonucleotide
aagtttcctggtcgcccgcttctgaaaagttagtttga

SEQ ID NO: 1837 - DNA, 38 bp, Artificial Sequence
  Synthetic oligonucleotide
aagagggctatgatttagccggtgcctccttgctttga

SEQ ID NO: 1838 - DNA, 37 bp, Artificial Sequence
  Synthetic oligonucleotide
aagccggtatcgcccgtaacattcccttcctctagga

SEQ ID NO: 1839 - DNA, 38 bp, Artificial Sequence
  Synthetic oligonucleotide
aacttcaccgatacggttcttttctctaacccgcttga

SEQ ID NO: 1840 - DNA, 37 bp, Artificial Sequence
  Synthetic oligonucleotide
aaggatagccataggctgatggggactcaacaggtga

SEQ ID NO: 1841 - DNA, 36 bp, Artificial Sequence
  Synthetic oligonucleotide
aatcgtcttacgtgcccttgataaatcccatactaa

SEQ ID NO: 1842 - DNA, 38 bp, Artificial Sequence
  Synthetic oligonucleotide
aattcgcgcgaattgaagaggcccatggcccgctctga

SEQ ID NO: 1843 - DNA, 37 bp, Artificial Sequence
  Synthetic oligonucleotide
accatgaatcaccgcgcctgctactgcaacttttgga

SEQ ID NO: 1844 - DNA, 36 bp, Artificial Sequence
  Synthetic oligonucleotide
acactggcatttttcgaaacatagaatgaatgggaa

SEQ ID NO: 1845 - DNA, 37 bp, Artificial Sequence
  Synthetic oligonucleotide
acacccacaagctttaacttatcataactcgccccga

SEQ ID NO: 1846 - DNA, 35 bp, Artificial Sequence
  Synthetic oligonucleotide
acccaacgttgagcgcaataccccttcataatacc

SEQ ID NO: 1847 - DNA, 35 bp, Artificial Sequence
  Synthetic oligonucleotide
acctctctctgaaatttaactctattctcccattc

SEQ ID NO: 1848 - DNA, 35 bp, Artificial Sequence
  Synthetic oligonucleotide
accggactagatatttaccacattgcatttccata

SEQ ID NO: 1849 - DNA, 35 bp, Artificial Sequence
  Synthetic oligonucleotide
acgctgaatctggttcacaacggggaacgtgttag

SEQ ID NO: 1850 - DNA, 38 bp, Artificial Sequence
  Synthetic oligonucleotide
acccgctgtgtgaaccaccgtgccttcggacgtcatga

SEQ ID NO: 1851 - DNA, 35 bp, Artificial Sequence
  Synthetic oligonucleotide
accgctctctgaaatttatctctattctcccattc

SEQ ID NO: 1852 - DNA, 36 bp, Artificial Sequence
  Synthetic oligonucleotide
acggtacactcactttcctaaatccctctttatcta

SEQ ID NO: 1853 - DNA, 38 bp, Artificial Sequence
  Synthetic oligonucleotide
acgccccagcctatttaccttggagtttctttgactga

SEQ ID NO: 1854 - DNA, 35 bp, Artificial Sequence
  Synthetic oligonucleotide
acccggcgaagacgttagctctggcgctccgttca

SEQ ID NO: 1855 - DNA, 38 bp, Artificial Sequence
  Synthetic oligonucleotide
actatcccaggtttacattagtgtgccccgcattctga

SEQ ID NO: 1856 - DNA, 38 bp, Artificial Sequence
  Synthetic oligonucleotide
actgctttttttgcccaatatctcgagtaaccccctga

SEQ ID NO: 1857 - DNA, 35 bp, Artificial Sequence
  Synthetic oligonucleotide
actgaacactctacatgaccataaacacctctctt

SEQ ID NO: 1858 - DNA, 37 bp, Artificial Sequence
  Synthetic oligonucleotide
actcgggcttccatcaagcttctgattggtgaggtga

SEQ ID NO: 1859 - DNA, 35 bp, Artificial Sequence
  Synthetic oligonucleotide
actgaacactctacatgactgtaaacacctctctt

SEQ ID NO: 1860 - DNA, 38 bp, Artificial Sequence
  Synthetic oligonucleotide
acgtttttctcgctcgtaattttatcgttaatttctga

SEQ ID NO: 1861 - DNA, 37 bp, Artificial Sequence
  Synthetic oligonucleotide
actactcatccccccgtcttaacaacgatcccactga

SEQ ID NO: 1862 - DNA, 37 bp, Artificial Sequence
  Synthetic oligonucleotide
actacgcgctcatcggccagagttccggtcaaccgga

SEQ ID NO: 1863 - DNA, 36 bp, Artificial Sequence
  Synthetic oligonucleotide
acttcacccacacaatacccttatcgataactcaaa

SEQ ID NO: 1864 - DNA, 36 bp, Artificial Sequence
  Synthetic oligonucleotide
acgttacgccgggggactataagcagttcagtagca

SEQ ID NO: 1865 - DNA, 36 bp, Artificial Sequence
  Synthetic oligonucleotide
agacctattccccaatcctgaattacaacatctcta

SEQ ID NO: 1866 - DNA, 35 bp, Artificial Sequence
  Synthetic oligonucleotide
agcacccgcccgcttctattcctcgatcctacact

SEQ ID NO: 1867 - DNA, 35 bp, Artificial Sequence
  Synthetic oligonucleotide
agccccagagtttatccggcttggccggcaattcc

SEQ ID NO: 1868 - DNA, 35 bp, Artificial Sequence
  Synthetic oligonucleotide
aggaatcgatcctggtggttttagctttgaccctt

SEQ ID NO: 1869 - DNA, 37 bp, Artificial Sequence
  Synthetic oligonucleotide
agacttagactcaataactggaccctttacacaccgt

SEQ ID NO: 1870 - DNA, 37 bp, Artificial Sequence; identical to SEQ ID NO: 1555
  Synthetic oligonucleotide

SEQ ID NO: 1871 - DNA, 38 bp, Artificial Sequence
  Synthetic oligonucleotide
atacacgctgcccatttccactcgtcaaaccactatga

SEQ ID NO: 1872 - DNA, 35 bp, Artificial Sequence
  Synthetic oligonucleotide
agttcgcgcaaccccttctcgcttgtgtggcttaa

SEQ ID NO: 1873 - DNA, 35 bp, Artificial Sequence
  Synthetic oligonucleotide
atcaagccggtgtaggcgctccaggcctttcagcc

SEQ ID NO: 1874 - DNA, 35 bp, Artificial Sequence
  Synthetic oligonucleotide
agtcatccattacctcaatgttcatctattttcac

SEQ ID NO: 1875 - DNA, 38 bp, Artificial Sequence
  Synthetic oligonucleotide
atcctctacgttccaaccacttacttttatgccattga

SEQ ID NO: 1876 - DNA, 38 bp, Artificial Sequence
  Synthetic oligonucleotide
atcacactctaactgtaatcaatcatttcgaaccctga

SEQ ID NO: 1877 - DNA, 38 bp, Artificial Sequence
  Synthetic oligonucleotide
atcccttccaattccctataattactactctaatgtga

SEQ ID NO: 1878 - DNA, 37 bp, Artificial Sequence
  Synthetic oligonucleotide
atcccacttgccatcttcggtcctatcaaatggtaga

SEQ ID NO: 1879 - DNA, 34 bp, Artificial Sequence
  Synthetic oligonucleotide
atcttaatgccttgatccgactcctacctcttga

SEQ ID NO: 1880 - DNA, 38 bp, Artificial Sequence
  Synthetic oligonucleotide
atgccccccgcgcttttaactcacacctgctctgctga

SEQ ID NO: 1881 - DNA, 35 bp, Artificial Sequence
  Synthetic oligonucleotide
atgcagtcgttaacgtccatcgcgtgtgtcttccg

SEQ ID NO: 1882 - DNA, 38 bp, Artificial Sequence
  Synthetic oligonucleotide
atcccttttattgttaaacttcatagaaatcatactga

SEQ ID NO: 1883 - DNA, 37 bp, Artificial Sequence
  Synthetic oligonucleotide
atcttcccgccacttgtgccttatcattaccccccga

SEQ ID NO: 1884 - DNA, 36 bp, Artificial Sequence
  Synthetic oligonucleotide
atcccaattcacatacactctcaccctcactaaaca

SEQ ID NO: 1885 - DNA, 36 bp, Artificial Sequence
  Synthetic oligonucleotide
atctacaccctatcgaaacttcccatgaaactacaa

SEQ ID NO: 1886 - DNA, 35 bp, Artificial Sequence
  Synthetic oligonucleotide
attggtgcccgttgtgaggatcaagcaacatgcta

SEQ ID NO: 1887 - DNA, 38 bp, Artificial Sequence
  Synthetic oligonucleotide
caaacgtaccttactgcatacaccttccctgttattga

SEQ ID NO: 1888 - DNA, 35 bp, Artificial Sequence
  Synthetic oligonucleotide
attgaacgagcgagaaatctaagcgccggcatctg

SEQ ID NO: 1889 - DNA, 35 bp, Artificial Sequence
  Synthetic oligonucleotide
atttcctaacattgctctcttaactgttcctatcc

SEQ ID NO: 1890 - DNA, 37 bp, Artificial Sequence
  Synthetic oligonucleotide
cacctggccattacactttccttttgagttctctcga

SEQ ID NO: 1891 - DNA, 38 bp, Artificial Sequence
  Synthetic oligonucleotide
attttagcatacggctccttggtttcatcagctgttga

SEQ ID NO: 1892 - DNA, 35 bp, Artificial Sequence
  Synthetic oligonucleotide
attcgaattctccacctgataaccgccacattaaa

SEQ ID NO: 1893 - DNA, 36 bp, Artificial Sequence
  Synthetic oligonucleotide
atgtttgtcggcctttgtgggtcctttcgcttccca

SEQ ID NO: 1894 - DNA, 38 bp, Artificial Sequence
  Synthetic oligonucleotide
ccgcaacccaactcgtattctaatctactacacattga

SEQ ID NO: 1895 - DNA, 36 bp, Artificial Sequence; identical to SEQ ID NO: 1541
  Synthetic oligonucleotide

SEQ ID NO: 1896 - DNA, 35 bp, Artificial Sequence
  Synthetic oligonucleotide
ccccaaggacgcacgggggtacccgcatactgtta

SEQ ID NO: 1897 - DNA, 36 bp, Artificial Sequence
  Synthetic oligonucleotide
ccagccggtccaggtggctgacccgcgaaggagcta

SEQ ID NO: 1898 - DNA, 37 bp, Artificial Sequence
  Synthetic oligonucleotide
cccgtcatgaaccgggacccaatcttaccttttatga

SEQ ID NO: 1899 - DNA, 37 bp, Artificial Sequence
  Synthetic oligonucleotide
ccgcgcgttagctacggatggcattaacccagttgga

SEQ ID NO: 1900 - DNA, 38 bp, Artificial Sequence
  Synthetic oligonucleotide
catggctctcatccgaagacgcgccttcttctatttga

SEQ ID NO: 1901 - DNA, 38 bp, Artificial Sequence
  Synthetic oligonucleotide
ccgctggcgctattttttttctatgctgttggagctga

SEQ ID NO: 1902 - DNA, 36 bp, Artificial Sequence
  Synthetic oligonucleotide
catggatttagtcgtccctagccgaacttctgttaa

SEQ ID NO: 1903 - DNA, 38 bp, Artificial Sequence
  Synthetic oligonucleotide
ccgcttaacggggcacccaactaattcgatatctctga

SEQ ID NO: 1904 - DNA, 36 bp, Artificial Sequence
  Synthetic oligonucleotide
cggtccgtcgacccatgttttttggctctattgcta

SEQ ID NO: 1905 - DNA, 36 bp, Artificial Sequence; identical to SEQ ID NO: 1540
  Synthetic oligonucleotide

SEQ ID NO: 1906 - DNA, 38 bp, Artificial Sequence
  Synthetic oligonucleotide
cgctattattactctccccgggtaatatcctatattga

SEQ ID NO: 1907 - DNA, 36 bp, Artificial Sequence
  Synthetic oligonucleotide
ccttgaaaggtgtaacgcacgttggatcgtcgtgaa

SEQ ID NO: 1908 - DNA, 36 bp, Artificial Sequence
  Synthetic oligonucleotide
cgacgaaaccggacaccatacccttacgacttttaa

SEQ ID NO: 1909 - DNA, 35 bp, Artificial Sequence
  Synthetic oligonucleotide
ccttaccccgagcgtgcccccttcttaagtattcg

SEQ ID NO: 1910 - DNA, 36 bp, Artificial Sequence
  Synthetic oligonucleotide
cgttttatagtttcgatctaaggttcattatatata

SEQ ID NO: 1911 - DNA, 38 bp, Artificial Sequence
  Synthetic oligonucleotide
cgcttaattcttggttatattatctaactacgcaatga

SEQ ID NO: 1912 - DNA, 37 bp, Artificial Sequence
  Synthetic oligonucleotide
ctctaccgagtcccttacatatgtacccacttccaga

SEQ ID NO: 1913 - DNA, 37 bp, Artificial Sequence
  Synthetic oligonucleotide
gaacccgagggagggattctcaatgtgcaatgtatga

SEQ ID NO: 1914 - DNA, 38 bp, Artificial Sequence
  Synthetic oligonucleotide
cttcggggcactaccttcgtttttttgttctactatga

SEQ ID NO: 1915 - DNA, 37 bp, Artificial Sequence
  Synthetic oligonucleotide
gaagccccataaaagacgccgaaatattgcatctgga

SEQ ID NO: 1916 - DNA, 37 bp, Artificial Sequence
  Synthetic oligonucleotide
gaaactaaaccgactgggttaaattttatcatgcgga

SEQ ID NO: 1917 - DNA, 37 bp, Artificial Sequence
  Synthetic oligonucleotide
gagcttaaacctctccgagcgcttatggctcgattga

SEQ ID NO: 1918 - DNA, 35 bp, Artificial Sequence
  Synthetic oligonucleotide
gaggaaacgcggcagccttataggccgatctttca

SEQ ID NO: 1919 - DNA, 38 bp, Artificial Sequence
  Synthetic oligonucleotide
gaggtttaataaataggccatgcttattggtccgctga

SEQ ID NO: 1920 - DNA, 37 bp, Artificial Sequence
  Synthetic oligonucleotide
gatcacgtcgcggattcccccgtttcgcgagaggaga

SEQ ID NO: 1921 - DNA, 37 bp, Artificial Sequence
  Synthetic oligonucleotide
gagttcctttatttgcatttttatcagatcaagttta

SEQ ID NO: 1922 - DNA, 36 bp, Artificial Sequence
  Synthetic oligonucleotide
gagtcctctacttcatataatctccagaggggggga

SEQ ID NO: 1923 - DNA, 35 bp, Artificial Sequence
  Synthetic oligonucleotide
gagtttcgatattcgtcttaaatccacccctgtaa

SEQ ID NO: 1924 - DNA, 36 bp, Artificial Sequence
  Synthetic oligonucleotide
gagtacgatttgaccactatcttcgtagattccata

SEQ ID NO: 1925 - DNA, 37 bp, Artificial Sequence
  Synthetic oligonucleotide
gataacgggaaccaaatcgcgctgtagaggcctggga

SEQ ID NO: 1926 - DNA, 36 bp, Artificial Sequence
  Synthetic oligonucleotide
gatctacccgaccctattaaccttagtacttgacaa

SEQ ID NO: 1927 - DNA, 38 bp, Artificial Sequence
  Synthetic oligonucleotide
gatccctaattgttttcctattaatcgttttcccatga

SEQ ID NO: 1928 - DNA, 36 bp, Artificial Sequence
  Synthetic oligonucleotide
gatcgctcgccaggcacactgccgtttcgagtatta

SEQ ID NO: 1929 - DNA, 36 bp, Artificial Sequence
  Synthetic oligonucleotide
gcacgacgaacgagtccgggaggaccggcttcccca

SEQ ID NO: 1930 - DNA, 35 bp, Artificial Sequence
  Synthetic oligonucleotide
gatcttatccggcccacatctttaaccccaacact

SEQ ID NO: 1931 - DNA, 35 bp, Artificial Sequence
  Synthetic oligonucleotide
gccgtctcggggtaatcggcctaatacgtagacat

SEQ ID NO: 1932 - DNA, 37 bp, Artificial Sequence
  Synthetic oligonucleotide
gccgcggggggccggggaggtcccatcgaggttatga

SEQ ID NO: 1933 - DNA, 38 bp, Artificial Sequence
  Synthetic oligonucleotide
gctaacctttgttatactaggactttctccacaggtga

SEQ ID NO: 1934 - DNA, 35 bp, Artificial Sequence
  Synthetic oligonucleotide
ggggtttcttggagcgcaatacggtttgtttctga

SEQ ID NO: 1935 - DNA, 35 bp, Artificial Sequence
  Synthetic oligonucleotide
ggcgaaactagcctggattggagttagacctttca

SEQ ID NO: 1936 - DNA, 38 bp, Artificial Sequence
  Synthetic oligonucleotide
gggggagttgcatggttgcaactctggaggccctttga

SEQ ID NO: 1937 - DNA, 37 bp, Artificial Sequence
  Synthetic oligonucleotide
gggtttaacgtgcccacccgtcagggtagtcctacga

SEQ ID NO: 1938 - DNA, 35 bp, Artificial Sequence
  Synthetic oligonucleotide
gggtatgccgttctgtccgggccttatgcgcatat

SEQ ID NO: 1939 - DNA, 37 bp, Artificial Sequence
  Synthetic oligonucleotide
gggacaatagaattaaactcgggcttaggtcctcgga

SEQ ID NO: 1940 - DNA, 37 bp, Artificial Sequence
  Synthetic oligonucleotide
ggggagatggctgggtcttgataccggaaacttgcga

SEQ ID NO: 1941 - DNA, 38 bp, Artificial Sequence
  Synthetic oligonucleotide
ggcttgtatacctattatgttaggcaggtgccctttga

SEQ ID NO: 1942 - DNA, 36 bp, Artificial Sequence
  Synthetic oligonucleotide
gtggcccggttgtgttgtcacggacgtgcggtccca

SEQ ID NO: 1943 - DNA, 36 bp, Artificial Sequence
  Synthetic oligonucleotide
gtgttgtatgtcttcgcaatcctagccgaccgccaa

SEQ ID NO: 1944 - DNA, 38 bp, Artificial Sequence
  Synthetic oligonucleotide
gtgcgcgttggtgggccgcttgtaactataccctttga

SEQ ID NO: 1945 - DNA, 35 bp, Artificial Sequence
  Synthetic oligonucleotide
gttttggtggttcaaaccggtcgcccactggcatt

SEQ ID NO: 1946 - DNA, 36 bp, Artificial Sequence
  Synthetic oligonucleotide
tacatcccggctagatccgtgaggactggcggtgtc

SEQ ID NO: 1947 - DNA, 38 bp, Artificial Sequence
  Synthetic oligonucleotide
taaaagaactcttttcgtcaaccatacctcaggcctga

SEQ ID NO: 1948 - DNA, 37 bp, Artificial Sequence
  Synthetic oligonucleotide
tagtccatatatagcttaaactgatgcgggggttcga

SEQ ID NO: 1949 - DNA, 35 bp, Artificial Sequence
  Synthetic oligonucleotide
tacccttatcggcacccccacacttatggtaattc

SEQ ID NO: 1950 - DNA, 36 bp, Artificial Sequence
  Synthetic oligonucleotide
tacgggaatgggtttggccctaaaagccagacacga

SEQ ID NO: 1951 - DNA, 36 bp, Artificial Sequence
  Synthetic oligonucleotide
tagctaacggtcccaacaagcatgttgggattggca

SEQ ID NO: 1952 - DNA, 38 bp, Artificial Sequence
  Synthetic oligonucleotide
tacgccatgatacttacatctagccaccttttttttga

SEQ ID NO: 1953 - DNA, 36 bp, Artificial Sequence
  Synthetic oligonucleotide
tatatctggccaccggcgggggggctggtgatctta

SEQ ID NO: 1954 - DNA, 36 bp, Artificial Sequence; identical to SEQ ID NO: 1720
  Synthetic oligonucleotide

SEQ ID NO: 1955 - DNA, 38 bp, Artificial Sequence
  Synthetic oligonucleotide
tatcaaattcggtcgtagtatttgtcgccgtaacgtta

SEQ ID NO: 1956 - DNA, 38 bp, Artificial Sequence
  Synthetic oligonucleotide
tactagcgatcatttgttcgctttgggttggttattga

SEQ ID NO: 1957 - DNA, 35 bp, Artificial Sequence
  Synthetic oligonucleotide
taggtggtcgtgcctacattgactgtttccatcca

SEQ ID NO: 1958 - DNA, 35 bp, Artificial Sequence
  Synthetic oligonucleotide
tactccggcccaactatatacttctccacacctcc

SEQ ID NO: 1959 - DNA, 37 bp, Artificial Sequence
  Synthetic oligonucleotide
tatcacgacttcccaccttcttccgcctttgtcccaa

SEQ ID NO: 1960 - DNA, 37 bp, Artificial Sequence
  Synthetic oligonucleotide
tcacagggcctgaaggtagtagatattaaacgctgga

SEQ ID NO: 1961 - DNA, 35 bp, Artificial Sequence
  Synthetic oligonucleotide
tcattatacggatcccgcgccgaacctggccgact

SEQ ID NO: 1962 - DNA, 38 bp, Artificial Sequence
  Synthetic oligonucleotide
tcactttggtaaactattcccccgtttctctcctatga

SEQ ID NO: 1963 - DNA, 37 bp, Artificial Sequence
  Synthetic oligonucleotide
tcaatacgcgtccggaaatccccctgtgcaagctgga

SEQ ID NO: 1964 - DNA, 37 bp, Artificial Sequence
  Synthetic oligonucleotide
tcaatgcttgctgctcgtagctttcaaccgtggtgga

SEQ ID NO: 1965 - DNA, 35 bp, Artificial Sequence
  Synthetic oligonucleotide
tatcgtttgccatattccgccagagaaaagtctcc

SEQ ID NO: 1966 - DNA, 38 bp, Artificial Sequence
  Synthetic oligonucleotide
tcctcgtggcttaccggtatactcccccaactcattga

SEQ ID NO: 1967 - DNA, 37 bp, Artificial Sequence
  Synthetic oligonucleotide
tccctccccgttgcccttattccgtactcacttatga

SEQ ID NO: 1968 - DNA, 38 bp, Artificial Sequence
  Synthetic oligonucleotide
tcctgtctccgctaggtaacatccgaatactctcttga

SEQ ID NO: 1969 - DNA, 36 bp, Artificial Sequence
  Synthetic oligonucleotide
tcctcgaccatctacaaactttgaagccacacccca

SEQ ID NO: 1970 - DNA, 35 bp, Artificial Sequence; identical to SEQ ID NO: 1551
  Synthetic oligonucleotide

SEQ ID NO: 1971 - DNA, 38 bp, Artificial Sequence
  Synthetic oligonucleotide
tccactcaatccccggttcgtatgctctgtaccattga

SEQ ID NO: 1972 - DNA, 38 bp, Artificial Sequence
  Synthetic oligonucleotide
tcccgtcccacctttactttgctacttcaccatcttga

SEQ ID NO: 1973 - DNA, 38 bp, Artificial Sequence
  Synthetic oligonucleotide
tccttgcatacctcggctctcctttctctcacatttga

SEQ ID NO: 1974 - DNA, 37 bp, Artificial Sequence
  Synthetic oligonucleotide
tctcgtgcgcgatttctgttctagggtaggagaggga

SEQ ID NO: 1975 - DNA, 38 bp, Artificial Sequence
  Synthetic oligonucleotide
tcggctcatccaaaattacttgcgggtttcataaatga

SEQ ID NO: 1976 - DNA, 36 bp, Artificial Sequence
  Synthetic oligonucleotide
tctcgcacctttattttctccgctcttttgtttcca

SEQ ID NO: 1977 - DNA, 38 bp, Artificial Sequence
  Synthetic oligonucleotide
tcgctacaattggccttttctgtatttgggttctatga

SEQ ID NO: 1978 - DNA, 37 bp, Artificial Sequence
  Synthetic oligonucleotide
tgcacgccgagcaaggcggtactctaggacccacgga

SEQ ID NO: 1979 - DNA, 38 bp, Artificial Sequence
  Synthetic oligonucleotide
tgccgcttttaccacttgacttacgataagaaaactga

SEQ ID NO: 1980 - DNA, 37 bp, Artificial Sequence
  Synthetic oligonucleotide
tgagtttttctaaataccgcagcctcagccacgcgga

SEQ ID NO: 1981 - DNA, 34 bp, Artificial Sequence
  Synthetic oligonucleotide
tgccttttttttcaccggtttgattccgctttcg

SEQ ID NO: 1982 - DNA, 35 bp, Artificial Sequence
  Synthetic oligonucleotide
tgaaagccaggtattttggggctcctttttcctcc

SEQ ID NO: 1983 - DNA, 38 bp, Artificial Sequence
  Synthetic oligonucleotide
tgacctacaaagggtttgaaataaatcgctcgacgtga

SEQ ID NO: 1984 - DNA, 35 bp, Artificial Sequence
  Synthetic oligonucleotide
tggaaagttagatttcctggggtctcgctttgagt

SEQ ID NO: 1985 - DNA, 35 bp, Artificial Sequence
  Synthetic oligonucleotide
tgtacttacttttactcgatcaccttataatttcc

SEQ ID NO: 1986 - DNA, 38 bp, Artificial Sequence
  Synthetic oligonucleotide
tggcctattctcgtacaatttacttcttatcatcctga

SEQ ID NO: 1987 - DNA, 38 bp, Artificial Sequence
  Synthetic oligonucleotide
ttagtacgtgccgagccccgagccctagagacctgtga

SEQ ID NO: 1988 - DNA, 36 bp, Artificial Sequence; identical to SEQ ID NO: 1730
  Synthetic oligonucleotide

SEQ ID NO: 1989 - DNA, 35 bp, Artificial Sequence
  Synthetic oligonucleotide
tgttagttccactttccgataatccgtcttcctta

SEQ ID NO: 1990 - DNA, 36 bp, Artificial Sequence
  Synthetic oligonucleotide
tgttaggcctttatttaccttatcttaattgtttta

SEQ ID NO: 1991 - DNA, 38 bp, Artificial Sequence
  Synthetic oligonucleotide
tgtttttacacgcctactttttatctatctccacatga

SEQ ID NO: 1992 - DNA, 38 bp, Artificial Sequence
  Synthetic oligonucleotide
ttccccttttatttgcccgtaataatcgcttgacatga

SEQ ID NO: 1993 - DNA, 38 bp, Artificial Sequence
  Synthetic oligonucleotide
ttgaacctcggtagagccgtaaggcctatccggtttga

SEQ ID NO: 1994 - DNA, 37 bp, Artificial Sequence
  Synthetic oligonucleotide
ttcgacccttttccatacttcttctcacgcaaattga

SEQ ID NO: 1995 - DNA, 35 bp, Artificial Sequence
  Synthetic oligonucleotide
ttcttaatgtaaacttttgttgatactgtgccacc

SEQ ID NO: 1996 - DNA, 36 bp, Artificial Sequence
  Synthetic oligonucleotide
ttcccctctactcgcctattttcctcataaaattta

SEQ ID NO: 1997 - DNA, 35 bp, Artificial Sequence
  Synthetic oligonucleotide
ttcctcccccccgtgcaattttagaggtcccgtgg

SEQ ID NO: 1998 - DNA, 35 bp, Artificial Sequence
  Synthetic oligonucleotide
ttctcaccgtacatcccttacctatccccttttat

SEQ ID NO: 1999 - DNA, 38 bp, Artificial Sequence; identical to SEQ ID NO: 1804
  Synthetic oligonucleotide

SEQ ID NO: 2000 - DNA, 36 bp, Artificial Sequence
  Synthetic oligonucleotide
tttgcgaatctagctttcctgtatacatgacaataa

SEQ ID NO: 2001 - DNA, 35 bp, Artificial Sequence
  Synthetic oligonucleotide
ttggtctattatgctctatatgtgaagtgcgaaaa

SEQ ID NO: 2002 - DNA, 35 bp, Artificial Sequence
  Synthetic oligonucleotide
ttttagttccactttccgataatccgccttcctta

SEQ ID NO: 2003 - DNA, 35 bp, Artificial Sequence
  Synthetic oligonucleotide
ttttagtatacccaccgcgatactctcagtcttgc

SEQ ID NO: 2004 - DNA, 38 bp, Artificial Sequence
  Synthetic oligonucleotide
ttttggcgtgagctccaggtagtggttgaaacccatga

SEQ ID NO: 2005 - DNA, 37 bp, Artificial Sequence
  Synthetic oligonucleotide
agttcgccgttggaggctctttcgacatcatgctaga

SEQ ID NO: 2006 - DNA, 36 bp, Artificial Sequence; identical to SEQ ID NO: 1586
  Synthetic oligonucleotide

SEQ ID NO: 2007 - DNA, 35 bp, Artificial Sequence
  Synthetic oligonucleotide
aaagcgatcacgtttctttgggctgctgtctagca

SEQ ID NO: 2008 - DNA, 36 bp, Artificial Sequence
  Synthetic oligonucleotide
ccattaacggtaagacttaattccgtttggcgtgta

SEQ ID NO: 2009 - DNA, 37 bp, Artificial Sequence; identical to SEQ ID NO: 1587
  Synthetic oligonucleotide

SEQ ID NO: 2010 - DNA, 36 bp, Artificial Sequence
  Synthetic oligonucleotide
aatcgtactcacggtgacatccttggtttgatggta

SEQ ID NO: 2011 - DNA, 36 bp, Artificial Sequence; identical to SEQ ID NO: 1590
  Synthetic oligonucleotide

SEQ ID NO: 2012 - DNA, 38 bp, Artificial Sequence
  Synthetic oligonucleotide
gagttttactgccgtgtcaattatcggtcctgtgttga

SEQ ID NO: 2013 - DNA, 38 bp, Artificial Sequence
  Synthetic oligonucleotide
cgggacgaatcttagtttattccattcgcaagtgctga

SEQ ID NO: 2014 - DNA, 35 bp, Artificial Sequence
  Synthetic oligonucleotide
gatcataccgcgatatagacattgcaccgtttcta

SEQ ID NO: 2015 - DNA, 35 bp, Artificial Sequence; identical to SEQ ID NO: 1591
  Synthetic oligonucleotide

SEQ ID NO: 2016 - DNA, 38 bp, Artificial Sequence
  Synthetic oligonucleotide
agggacgaatcttagtttattccattcgcaagtgctga

SEQ ID NO: 2017 - DNA, 38 bp, Artificial Sequence
  Synthetic oligonucleotide
atcgcttaagttccgtaagggttaaggttcgttattga

SEQ ID NO: 2018 - DNA, 35 bp, Artificial Sequence
  Synthetic oligonucleotide
gagtacgcgcaatgacaatcgacttgttttcggtc

SEQ ID NO: 2019 - DNA, 37 bp, Artificial Sequence; identical to SEQ ID NO: 1595
  Synthetic oligonucleotide

SEQ ID NO: 2020 - DNA, 36 bp, Artificial Sequence
  Synthetic oligonucleotide
cctcagtttacgtactcatcttgaatgggggaaata

SEQ ID NO: 2021 - DNA, 38 bp, Artificial Sequence; identical to SEQ ID NO: 1596
  Synthetic oligonucleotide

SEQ ID NO: 2022 - DNA, 35 bp, Artificial Sequence; identical to SEQ ID NO: 1597
  Synthetic oligonucleotide

SEQ ID NO: 2023 - DNA, 38 bp, Artificial Sequence
  Synthetic oligonucleotide
agattaggttgctctgtcccgtgcttaagtatcgctga

SEQ ID NO: 2024 - DNA, 38 bp, Artificial Sequence
  Synthetic oligonucleotide
acattttccgcatgggacggaatgttcttcttcattga

SEQ ID NO: 2025 - DNA, 36 bp, Artificial Sequence; identical to SEQ ID NO: 1750
  Synthetic oligonucleotide

SEQ ID NO: 2026 - DNA, 36 bp, Artificial Sequence; identical to SEQ ID NO: 1598
  Synthetic oligonucleotide

SEQ ID NO: 2027 - DNA, 35 bp, Artificial Sequence; identical to SEQ ID NO: 1426
  Synthetic oligonucleotide

SEQ ID NO: 2028 - DNA, 35 bp, Artificial Sequence
  Synthetic oligonucleotide
tacctcatgtttgtcactatggaaatcatcccgcc

SEQ ID NO: 2029 - DNA, 35 bp, Artificial Sequence
  Synthetic oligonucleotide
tgcttctgcatgcaacgtgctctggactagctgtc

SEQ ID NO: 2030 - DNA, 35 bp, Artificial Sequence; identical to SEQ ID NO: 1599
  Synthetic oligonucleotide

SEQ ID NO: 2031 - DNA, 37 bp, Artificial Sequence; identical to SEQ ID NO: 1650
  Synthetic oligonucleotide

SEQ ID NO: 2032 - DNA, 36 bp, Artificial Sequence; identical to SEQ ID NO: 1638
  Synthetic oligonucleotide

SEQ ID NO: 2033 - DNA, 37 bp, Artificial Sequence; identical to SEQ ID NO: 1649
  Synthetic oligonucleotide

SEQ ID NO: 2034 - DNA, 38 bp, Artificial Sequence; identical to SEQ ID NO: 1601
  Synthetic oligonucleotide

SEQ ID NO: 2035 - DNA, 36 bp, Artificial Sequence; identical to SEQ ID NO: 1602
  Synthetic oligonucleotide

SEQ ID NO: 2036 - DNA, 36 bp, Artificial Sequence; identical to SEQ ID NO: 1603
  Synthetic oligonucleotide

SEQ ID NO: 2037 - DNA, 36 bp, Artificial Sequence
  Synthetic oligonucleotide
ttggcctttgagttagtgcctagatagcctgagtta

SEQ ID NO: 2038 - DNA, 36 bp, Artificial Sequence
  Synthetic oligonucleotide
tcattggttccgatccggggctctggacctgacata

SEQ ID NO: 2039 - DNA, 36 bp, Artificial Sequence; identical to SEQ ID NO: 1604
  Synthetic oligonucleotide

SEQ ID NO: 2040 - DNA, 35 bp, Artificial Sequence; identical to SEQ ID NO: 1605
  Synthetic oligonucleotide

SEQ ID NO: 2041 - DNA, 36 bp, Artificial Sequence
  Synthetic oligonucleotide
gcggagcgcttatataatggtgttgtaggtccatta

SEQ ID NO: 2042 - DNA, 35 bp, Artificial Sequence
  Synthetic oligonucleotide
gtacgccgctgccaataatgtctgttgttacattc

SEQ ID NO: 2043 - DNA, 36 bp, Artificial Sequence
  Synthetic oligonucleotide
tttaatggggagctacgtctcgaatcgattttggta

SEQ ID NO: 2044 - DNA, 35 bp, Artificial Sequence; identical to SEQ ID NO: 1606
  Synthetic oligonucleotide

SEQ ID NO: 2045 - DNA, 35 bp, Artificial Sequence
  Synthetic oligonucleotide
ttcccttgttcgagtttcccagcctggacgccctg

SEQ ID NO: 2046 - DNA, 36 bp, Artificial Sequence
  Synthetic oligonucleotide
tccctgtcggtccaaacgtaagggcgggctaaaaca

SEQ ID NO: 2047 - DNA, 36 bp, Artificial Sequence
  Synthetic oligonucleotide
gtctggctggaaaatcagggttgcctatgtttcaaa

SEQ ID NO: 2048 - DNA, 36 bp, Artificial Sequence
  Synthetic oligonucleotide
tacattccgggctgttcagcaatgtcgctccagtta

SEQ ID NO: 2049 - DNA, 38 bp, Artificial Sequence; identical to SEQ ID NO: 1609
  Synthetic oligonucleotide

SEQ ID NO: 2050 - DNA, 35 bp, Artificial Sequence
  Synthetic oligonucleotide
tttgcaagttcgctccgtatatccactgtgaagac

SEQ ID NO: 2051 - DNA, 35 bp, Artificial Sequence
  Synthetic oligonucleotide
tttgcaagttcgctccgtatatccactgtgaagcc

SEQ ID NO: 2052 - DNA, 36 bp, Artificial Sequence
  Synthetic oligonucleotide
tcctctccgtctgtgaagacgtgtgtggcggaatta

SEQ ID NO: 2053 - DNA, 35 bp, Artificial Sequence; identical to SEQ ID NO: 1644
  Synthetic oligonucleotide

SEQ ID NO: 2054 - DNA, 36 bp, Artificial Sequence; identical to SEQ ID NO: 1611
  Synthetic oligonucleotide

SEQ ID NO: 2055 - DNA, 37 bp, Artificial Sequence
  Synthetic oligonucleotide
aaccaaacctgtacccgaataaatcatccattaacga

SEQ ID NO: 2056 - DNA, 36 bp, Artificial Sequence
  Synthetic oligonucleotide
aacccaattcacatactctctcaccctcactaaaca

SEQ ID NO: 2057 - DNA, 37 bp, Artificial Sequence
  Synthetic oligonucleotide
aacaacctcgaatttgtataggttcgcatcactctga

SEQ ID NO: 2058 - DNA, 35 bp, Artificial Sequence
  Synthetic oligonucleotide
aactgtcatccgctgactaactcaatctaactcca

SEQ ID NO: 2059 - DNA, 38 bp, Artificial Sequence
  Synthetic oligonucleotide
acattaaggatttatcttcacccatttttgcctcttga

SEQ ID NO: 2060 - DNA, 38 bp, Artificial Sequence
  Synthetic oligonucleotide
acaaagtaacgtacctcagttccggtacttacgggtga

SEQ ID NO: 2061 - DNA, 35 bp, Artificial Sequence
  Synthetic oligonucleotide
accccacctgcacaccttcatctcatctattacat

SEQ ID NO: 2062 - DNA, 38 bp, Artificial Sequence; identical to SEQ ID NO: 2024
  Synthetic oligonucleotide

SEQ ID NO: 2063 - DNA, 37 bp, Artificial Sequence
  Synthetic oligonucleotide
acaattaatataaattccttacatcaatcctagacga

SEQ ID NO: 2064 - DNA, 38 bp, Artificial Sequence
  Synthetic oligonucleotide
acattcccgtggtggtccttacgggtgggccagcctga

SEQ ID NO: 2065 - DNA, 38 bp, Artificial Sequence; identical to SEQ ID NO: 1612
  Synthetic oligonucleotide

SEQ ID NO: 2066 - DNA, 35 bp, Artificial Sequence
  Synthetic oligonucleotide
accggactgcacagggatcccgataggagggtgac

SEQ ID NO: 2067 - DNA, 37 bp, Artificial Sequence
  Synthetic oligonucleotide
acccttgcaatcaatccccccttttacctgtacatga

SEQ ID NO: 2068 - DNA, 36 bp, Artificial Sequence
  Synthetic oligonucleotide
actcgcccttcacgactttatccaaatttactttca

SEQ ID NO: 2069 - DNA, 35 bp, Artificial Sequence
  Synthetic oligonucleotide
acgtctgccaaatctactcgcattcgatacacaca

SEQ ID NO: 2070 - DNA, 35 bp, Artificial Sequence
  Synthetic oligonucleotide
actactgggcgcactagcgcgaggctccactgaat

SEQ ID NO: 2071 - DNA, 38 bp, Artificial Sequence
  Synthetic oligonucleotide
actcacattcccaccccctattgcctttaaatacctga

SEQ ID NO: 2072 - DNA, 37 bp, Artificial Sequence
  Synthetic oligonucleotide
actgcagcatcaagccactaattggggcttgtatcga

SEQ ID NO: 2073 - DNA, 37 bp, Artificial Sequence
  Synthetic oligonucleotide
acggttggagcttgtgggaaactaggttgggttcgga

SEQ ID NO: 2074 - DNA, 35 bp, Artificial Sequence; identical to SEQ ID NO: 1597
  Synthetic oligonucleotide

SEQ ID NO: 2075 - DNA, 35 bp, Artificial Sequence
  Synthetic oligonucleotide
agcacccacccgcttctattcctcgatcatacact

SEQ ID NO: 2076 - DNA, 35 bp, Artificial Sequence; identical to SEQ ID NO: 1591
  Synthetic oligonucleotide

SEQ ID NO: 2077 - DNA, 36 bp, Artificial Sequence; identical to SEQ ID NO: 1590
  Synthetic oligonucleotide

SEQ ID NO: 2078 - DNA, 35 bp, Artificial Sequence
  Synthetic oligonucleotide
agattgctccgcagtacggtgtagggcgataaaaa

SEQ ID NO: 2079 - DNA, 35 bp, Artificial Sequence
  Synthetic oligonucleotide
agccgcccctttagacagaggttacgacttgcgta

SEQ ID NO: 2080 - DNA, 38 bp, Artificial Sequence
  Synthetic oligonucleotide
actttggggctttctcggtcttcgcactatggtactga

SEQ ID NO: 2081 - DNA, 36 bp, Artificial Sequence; identical to SEQ ID NO: 1617
  Synthetic oligonucleotide

SEQ ID NO: 2082 - DNA, 36 bp, Artificial Sequence
  Synthetic oligonucleotide
agaaccccattctcattccaccagttactacgctta

SEQ ID NO: 2083 - DNA, 36 bp, Artificial Sequence
  Synthetic oligonucleotide
aggtatacaaatgtgtagtctagtcctgccgatcga

SEQ ID NO: 2084 - DNA, 36 bp, Artificial Sequence; identical to SEQ ID NO: 1586
  Synthetic oligonucleotide

SEQ ID NO: 2085 - DNA, 36 bp, Artificial Sequence
  Synthetic oligonucleotide
agggattcgccctgtgtcacgctcaaactgtagtaa

SEQ ID NO: 2086 - DNA, 38 bp, Artificial Sequence
  Synthetic oligonucleotide
agtaatccccggcgtataatttcagtcctgtggtttga

SEQ ID NO: 2087 - DNA, 35 bp, Artificial Sequence
  Synthetic oligonucleotide
agttgatgcagtgggacctgagattaggcttatga

SEQ ID NO: 2088 - DNA, 36 bp, Artificial Sequence
  Synthetic oligonucleotide
agtattcctctggtagtatttttccttaattccgta

SEQ ID NO: 2089 - DNA, 35 bp, Artificial Sequence; identical to SEQ ID NO: 1620
  Synthetic oligonucleotide

SEQ ID NO: 2090 - DNA, 35 bp, Artificial Sequence
  Synthetic oligonucleotide
agtacctcttgtgggtcttggggctgccactgcct

SEQ ID NO: 2091 - DNA, 36 bp, Artificial Sequence
  Synthetic oligonucleotide
atcaccgtccttatcataaccagttcgttttttata

SEQ ID NO: 2092 - DNA, 36 bp, Artificial Sequence
  Synthetic oligonucleotide
atgcttccatctctgttttttaaccccttaccgtta

SEQ ID NO: 2093 - DNA, 35 bp, Artificial Sequence; identical to SEQ ID NO: 1594
  Synthetic oligonucleotide

SEQ ID NO: 2094 - DNA, 37 bp, Artificial Sequence
  Synthetic oligonucleotide
caccctaatcaccgctaaccttaccataacaatttga

SEQ ID NO: 2095 - DNA, 37 bp, Artificial Sequence
  Synthetic oligonucleotide
cagccgctctagttacaggtttactgcggctaaacga

SEQ ID NO: 2096 - DNA, 35 bp, Artificial Sequence
  Synthetic oligonucleotide
cacagtatccttgtacagattttgatggttgttgg

SEQ ID NO: 2097 - DNA, 35 bp, Artificial Sequence
  Synthetic oligonucleotide
catcggggtacgcttcctttaaaagatcctgtgcc

SEQ ID NO: 2098 - DNA, 36 bp, Artificial Sequence
  Synthetic oligonucleotide
attcatggtgccgtgagaaaataaccatgtacgcaa

SEQ ID NO: 2099 - DNA, 35 bp, Artificial Sequence
  Synthetic oligonucleotide
atttccataccattgtaggccttctcgtatcgtaa

SEQ ID NO: 2100 - DNA, 38 bp, Artificial Sequence
  Synthetic oligonucleotide
cccatagggcactttttacacccctcgcatactattga

SEQ ID NO: 2101 - DNA, 37 bp, Artificial Sequence
  Synthetic oligonucleotide
ccgtgatgcagatgaatgtacggacgtctgccggtga

SEQ ID NO: 2102 - DNA, 38 bp, Artificial Sequence
  Synthetic oligonucleotide
cccaccgagggcaggtggtgacgtttccccagccttga

SEQ ID NO: 2103 - DNA, 38 bp, Artificial Sequence
  Synthetic oligonucleotide
cccagacaactaccgcggagtagcggaagccgtactga

SEQ ID NO: 2104 - DNA, 36 bp, Artificial Sequence
  Synthetic oligonucleotide
ccgcgcatcacattgggctctgggatgcccgctgca

SEQ ID NO: 2105 - DNA, 35 bp, Artificial Sequence
  Synthetic oligonucleotide
cctagaccacgtgtgtgtcccgggtagggaagtct

SEQ ID NO: 2106 - DNA, 37 bp, Artificial Sequence; identical to SEQ ID NO: 1587
  Synthetic oligonucleotide

SEQ ID NO: 2107 - DNA, 36 bp, Artificial Sequence; identical to SEQ ID NO: 2008
  Synthetic oligonucleotide

SEQ ID NO: 2108 - DNA, 37 bp, Artificial Sequence
  Synthetic oligonucleotide
ccccaccgcgcacaccccgaactttacatatgcatga

SEQ ID NO: 2109 - DNA, 38 bp, Artificial Sequence
  Synthetic oligonucleotide
ccacacccattttgactgaacagcctatccggtactga

SEQ ID NO: 2110 - DNA, 36 bp, Artificial Sequence
  Synthetic oligonucleotide
cctgttcaattcatcctccaggttcgtgttacccta

SEQ ID NO: 2111 - DNA, 36 bp, Artificial Sequence
  Synthetic oligonucleotide
cctttcggactagcttctggcccatttggcgccata

SEQ ID NO: 2112 - DNA, 35 bp, Artificial Sequence
  Synthetic oligonucleotide
ctacaattagaagctcggtttcttctgcggtgacg

SEQ ID NO: 2113 - DNA, 38 bp, Artificial Sequence; identical to SEQ ID NO: 1596
  Synthetic oligonucleotide

SEQ ID NO: 2114 - DNA, 35 bp, Artificial Sequence
  Synthetic oligonucleotide
cgcgggggcctatatgctgtttccaccgctagtta

SEQ ID NO: 2115 - DNA, 35 bp, Artificial Sequence
  Synthetic oligonucleotide
cgctggctgcacgcacgcctgggcgcactgcccta

SEQ ID NO: 2116 - DNA, 35 bp, Artificial Sequence
  Synthetic oligonucleotide
cgtataggttaatacgtactggagcccggagggga

SEQ ID NO: 2117 - DNA, 37 bp, Artificial Sequence
  Synthetic oligonucleotide
cctgaatgggcggtccgcacttcgttagtatcccaga

SEQ ID NO: 2118 - DNA, 35 bp, Artificial Sequence
  Synthetic oligonucleotide
ctcaacgtagtctgcggagttactccagaatgacg

SEQ ID NO: 2119 - DNA, 38 bp, Artificial Sequence
  Synthetic oligonucleotide
gaacttcgcggtgactcgtgcccttcgttgtcctttga

SEQ ID NO: 2120 - DNA, 35 bp, Artificial Sequence
  Synthetic oligonucleotide
gaaccatcattggcttcatttagctattctacacc

SEQ ID NO: 2121 - DNA, 38 bp, Artificial Sequence
  Synthetic oligonucleotide
ctgtccttaaatggaaggtcattttggctcaggtctga

SEQ ID NO: 2122 - DNA, 37 bp, Artificial Sequence
  Synthetic oligonucleotide
gacacgggggcaaaggtggtttgtgtaccccgtacga

SEQ ID NO: 2123 - DNA, 37 bp, Artificial Sequence
  Synthetic oligonucleotide
gaaggtcatcggactgttctgtcaatccccctttgga

SEQ ID NO: 2124 - DNA, 35 bp, Artificial Sequence
  Synthetic oligonucleotide
gagctcaaatcggggactactgcattgtctactcg

SEQ ID NO: 2125 - DNA, 37 bp, Artificial Sequence; identical to SEQ ID NO: 1595
  Synthetic oligonucleotide

SEQ ID NO: 2126 - DNA, 38 bp, Artificial Sequence
  Synthetic oligonucleotide
gacgccttgaaagcgacgcctgatactcgggggcctga

SEQ ID NO: 2127 - DNA, 37 bp, Artificial Sequence
  Synthetic oligonucleotide
gagggccccaagtcaccgctgtagttctaggcccaga

SEQ ID NO: 2128 - DNA, 35 bp, Artificial Sequence
  Synthetic oligonucleotide
gacggtcgtactggagcatcctgagactgttcgag

SEQ ID NO: 2129 - DNA, 37 bp, Artificial Sequence; identical to SEQ ID NO: 1767
  Synthetic oligonucleotide

SEQ ID NO: 2130 - DNA, 35 bp, Artificial Sequence
  Synthetic oligonucleotide
gagtacaggtccggcgccctatcgagaaaggaaaa

SEQ ID NO: 2131 - DNA, 38 bp, Artificial Sequence
  Synthetic oligonucleotide
gagtactgccatgaggccagaggtaagaagccgaatga

SEQ ID NO: 2132 - DNA, 35 bp, Artificial Sequence
  Synthetic oligonucleotide
gagtacagttggattccgcccttgtatctgtacga

SEQ ID NO: 2133 - DNA, 37 bp, Artificial Sequence
  Synthetic oligonucleotide
gagtacctacccgtcgaatattgagattcgggaacga

SEQ ID NO: 2134 - DNA, 35 bp, Artificial Sequence
  Synthetic oligonucleotide
gagtctcatacccctgaatatgtttttatgctttc

SEQ ID NO: 2135 - DNA, 36 bp, Artificial Sequence
  Synthetic oligonucleotide
gagtggctcaaccagggtccagaattacaaaaaata

SEQ ID NO: 2136 - DNA, 36 bp, Artificial Sequence
  Synthetic oligonucleotide
gcaatgtcccctgttttctactaactctgatcttga

SEQ ID NO: 2137 - DNA, 36 bp, Artificial Sequence
  Synthetic oligonucleotide
gcagttctaaaggtggaagaatccaaatgacccaga

SEQ ID NO: 2138 - DNA, 35 bp, Artificial Sequence
  Synthetic oligonucleotide
gcaccttctcctttaattcccagccaataaccatc

SEQ ID NO: 2139 - DNA, 36 bp, Artificial Sequence
  Synthetic oligonucleotide
gatgtaacgggtctgcggggagtttgtcatgcggga

SEQ ID NO: 2140 - DNA, 35 bp, Artificial Sequence
  Synthetic oligonucleotide
gccatcatattcattattccatgcctccccatccc

SEQ ID NO: 2141 - DNA, 35 bp, Artificial Sequence; identical to SEQ ID NO: 2014
  Synthetic oligonucleotide

SEQ ID NO: 2142 - DNA, 36 bp, Artificial Sequence
  Synthetic oligonucleotide
gcaatgaacacctacacatacctgccttcacgatta

SEQ ID NO: 2143 - DNA, 36 bp, Artificial Sequence
  Synthetic oligonucleotide
gccctcacttcaacgtttcataactctacattaata

SEQ ID NO: 2144 - DNA, 38 bp, Artificial Sequence
  Synthetic oligonucleotide
gcgccgatggggcatcggtcgcgacagtcccgccgtga

SEQ ID NO: 2145 - DNA, 36 bp, Artificial Sequence
  Synthetic oligonucleotide
gcgttccccttggacaatatcactttcttatcgtaa

SEQ ID NO: 2146 - DNA, 35 bp, Artificial Sequence; identical to SEQ ID NO: 1600
  Synthetic oligonucleotide

SEQ ID NO: 2147 - DNA, 36 bp, Artificial Sequence
  Synthetic oligonucleotide
gcctctgccaagcaattcatcttaacgacctctcta

SEQ ID NO: 2148 - DNA, 35 bp, Artificial Sequence
  Synthetic oligonucleotide
gccgccggagcacggctgtctttatacgcactgta

SEQ ID NO: 2149 - DNA, 36 bp, Artificial Sequence; identical to SEQ ID NO: 2041
  Synthetic oligonucleotide

SEQ ID NO: 2150 - DNA, 38 bp, Artificial Sequence
  Synthetic oligonucleotide
gcgtacatagatctaggctttccatccaggatatgtga

SEQ ID NO: 2151 - DNA, 36 bp, Artificial Sequence
  Synthetic oligonucleotide
gcgccggcatactccttatattccactatccctgta

SEQ ID NO: 2152 - DNA, 38 bp, Artificial Sequence
  Synthetic oligonucleotide
gctaacgtactctttttttcaacttcactgactattga

SEQ ID NO: 2153 - DNA, 38 bp, Artificial Sequence
  Synthetic oligonucleotide
gctcccgaattgttttcctattaatcgttttcccatga

SEQ ID NO: 2154 - DNA, 36 bp, Artificial Sequence
  Synthetic oligonucleotide
gctgaacaggtcacggtcccccccacacgttaacta

SEQ ID NO: 2155 - DNA, 37 bp, Artificial Sequence
  Synthetic oligonucleotide
gctatacgactgcaagggtctgaccgcagggaattga

SEQ ID NO: 2156 - DNA, 36 bp, Artificial Sequence
  Synthetic oligonucleotide
gcttccgtatcaagagtggctcgcacccacagagta

SEQ ID NO: 2157 - DNA, 35 bp, Artificial Sequence
  Synthetic oligonucleotide
ggattacgtacccgactttttttctggttttcttt

SEQ ID NO: 2158 - DNA, 36 bp, Artificial Sequence
  Synthetic oligonucleotide
gggaccggaccctgtccttggtcgtttgatccacga

SEQ ID NO: 2159 - DNA, 38 bp, Artificial Sequence
  Synthetic oligonucleotide
ggtatttttttgtgctaatctcgccgaatcgtacctga

SEQ ID NO: 2160 - DNA, 36 bp, Artificial Sequence
  Synthetic oligonucleotide
ggctcaccgactccttactttgctggtactacctta

SEQ ID NO: 2161 - DNA, 37 bp, Artificial Sequence
  Synthetic oligonucleotide
gggaacgtaaggttttggtgaacagagggtagtaaga

SEQ ID NO: 2162 - DNA, 38 bp, Artificial Sequence
  Synthetic oligonucleotide
ggtgcttgtccctgtctctacgtaacttttgaagttga

SEQ ID NO: 2163 - DNA, 38 bp, Artificial Sequence; identical to SEQ ID NO: 1601
  Synthetic oligonucleotide

SEQ ID NO: 2164 - DNA, 35 bp, Artificial Sequence
  Synthetic oligonucleotide
ggggtccttttccatcacacatgtccagttccgta

SEQ ID NO: 2165 - DNA, 35 bp, Artificial Sequence
  Synthetic oligonucleotide
ggccttcttaccgactggggcttcgggttttacgt

SEQ ID NO: 2166 - DNA, 37 bp, Artificial Sequence
  Synthetic oligonucleotide
gtgggcccgcattgaaaccgcattcgtagagcctgga

SEQ ID NO: 2167 - DNA, 35 bp, Artificial Sequence; identical to SEQ ID NO: 2042
  Synthetic oligonucleotide

SEQ ID NO: 2168 - DNA, 37 bp, Artificial Sequence
  Synthetic oligonucleotide
gtacttgccgggttacgcagcgcgtccctcttcgcga

SEQ ID NO: 2169 - DNA, 37 bp, Artificial Sequence
  Synthetic oligonucleotide
gtgagctttacgtaatgcggtagttcgtactaacgga

SEQ ID NO: 2170 - DNA, 36 bp, Artificial Sequence; identical to SEQ ID NO: 1598
  Synthetic oligonucleotide

SEQ ID NO: 2171 - DNA, 38 bp, Artificial Sequence
  Synthetic oligonucleotide
gtcgcctatcccagtgcttcgaggggcgacgtgtctga

SEQ ID NO: 2172 - DNA, 37 bp, Artificial Sequence
  Synthetic oligonucleotide
gtgtacatttccgcgcaagctactcagttttttttga

SEQ ID NO: 2173 - DNA, 35 bp, Artificial Sequence
  Synthetic oligonucleotide
gtttactcctgtaccgtgaggtgaagggaaagcaa

SEQ ID NO: 2174 - DNA, 36 bp, Artificial Sequence; identical to SEQ ID NO: 2048
  Synthetic oligonucleotide

SEQ ID NO: 2175 - DNA, 37 bp, Artificial Sequence
  Synthetic oligonucleotide
gttttttactatggttcatctaggattccagtttaga

SEQ ID NO: 2176 - DNA, 36 bp, Artificial Sequence
  Synthetic oligonucleotide
gttctttcacggacggcctcctttccgatctattca

SEQ ID NO: 2177 - DNA, 36 bp, Artificial Sequence; identical to SEQ ID NO: 1602
  Synthetic oligonucleotide

SEQ ID NO: 2178 - DNA, 37 bp, Artificial Sequence
  Synthetic oligonucleotide
gttccgggctctttgtgtagtggtgagcacggcacga

SEQ ID NO: 2179 - DNA, 37 bp, Artificial Sequence
  Synthetic oligonucleotide
taaatgcccggttcattgaatcttcacaaagatggga

SEQ ID NO: 2180 - DNA, 36 bp, Artificial Sequence; identical to SEQ ID NO: 1603
  Synthetic oligonucleotide

SEQ ID NO: 2181 - DNA, 38 bp, Artificial Sequence
  Synthetic oligonucleotide
tacaccatgatacttacatctagcaaccttttttttga

SEQ ID NO: 2182 - DNA, 35 bp, Artificial Sequence
  Synthetic oligonucleotide
taaccgttcgctgggttccagtcccttgttaagcc

SEQ ID NO: 2183 - DNA, 36 bp, Artificial Sequence
  Synthetic oligonucleotide
tagtgttaaacgtgagtgcacttaatcaccctggta

SEQ ID NO: 2184 - DNA, 36 bp, Artificial Sequence
  Synthetic oligonucleotide
taccttgacctgcatcggttctcttcataatcctaa

SEQ ID NO: 2185 - DNA, 38 bp, Artificial Sequence
  Synthetic oligonucleotide
tagtcctgcactgttttacagttcttggtaatatttga

SEQ ID NO: 2186 - DNA, 35 bp, Artificial Sequence
  Synthetic oligonucleotide
tacttcaacacctcgctcgttacataccaatttct

SEQ ID NO: 2187 - DNA, 36 bp, Artificial Sequence; identical to SEQ ID NO: 1638
  Synthetic oligonucleotide

SEQ ID NO: 2188 - DNA, 35 bp, Artificial Sequence
  Synthetic oligonucleotide
tcatcgtcgcgtggccggtaggctgggaaatcctg

SEQ ID NO: 2189 - DNA, 37 bp, Artificial Sequence
  Synthetic oligonucleotide
tcacggatgcgaatcaaatgaactacctaagtccgga

SEQ ID NO: 2190 - DNA, 36 bp, Artificial Sequence; identical to SEQ ID NO: 2038
  Synthetic oligonucleotide

SEQ ID NO: 2191 - DNA, 35 bp, Artificial Sequence; identical to SEQ ID NO: 1777
  Synthetic oligonucleotide

SEQ ID NO: 2192 - DNA, 37 bp, Artificial Sequence
  Synthetic oligonucleotide
tccagccacatggatgaacagtgggccttttcacgga

SEQ ID NO: 2193 - DNA, 37 bp, Artificial Sequence; identical to SEQ ID NO: 1639
  Synthetic oligonucleotide

SEQ ID NO: 2194 - DNA, 38 bp, Artificial Sequence
  Synthetic oligonucleotide
tccttccgacgataacttacgtgtgacacgcgtactga

SEQ ID NO: 2195 - DNA, 38 bp, Artificial Sequence; identical to SEQ ID NO: 1608
  Synthetic oligonucleotide

SEQ ID NO: 2196 - DNA, 38 bp, Artificial Sequence
  Synthetic oligonucleotide
tcccgagtttgtcgatctcgagtggggcccttacctga

SEQ ID NO: 2197 - DNA, 36 bp, Artificial Sequence
  Synthetic oligonucleotide
tccctgtaacagggtctctctctttatatattctca

SEQ ID NO: 2198 - DNA, 37 bp, Artificial Sequence
  Synthetic oligonucleotide
tcgttcctcctttcgggtccgtgaggatccggaacga

SEQ ID NO: 2199 - DNA, 36 bp, Artificial Sequence; identical to SEQ ID NO: 1604
  Synthetic oligonucleotide

SEQ ID NO: 2200 - DNA, 37 bp, Artificial Sequence
  Synthetic oligonucleotide
tctcctttccaacgggacgctgtgttcccctcagtga

SEQ ID NO: 2201 - DNA, 35 bp, Artificial Sequence
  Synthetic oligonucleotide
tctgcactaccgtgaggtatggtgataggtggcga

SEQ ID NO: 2202 - DNA, 36 bp, Artificial Sequence
  Synthetic oligonucleotide
tcgggccagatcgcattcgtagttgctgtttccgta

SEQ ID NO: 2203 - DNA, 37 bp, Artificial Sequence
  Synthetic oligonucleotide
tgcacttaattccacttttccacccttttcactttga

SEQ ID NO: 2204 - DNA, 37 bp, Artificial Sequence
  Synthetic oligonucleotide
tgcacataattccacctttccacccttttcactttga

SEQ ID NO: 2205 - DNA, 38 bp, Artificial Sequence
  Synthetic oligonucleotide
tgagcatcttcacacgcatggctccacctcataaatga

SEQ ID NO: 2206 - DNA, 36 bp, Artificial Sequence; identical to SEQ ID NO: 1750
  Synthetic oligonucleotide

SEQ ID NO: 2207 - DNA, 37 bp, Artificial Sequence
  Synthetic oligonucleotide
tggtctgcacacgcacgtcgcctcttggggttatgga

SEQ ID NO: 2208 - DNA, 38 bp, Artificial Sequence
  Synthetic oligonucleotide
tgtagttttgcaatctatgggctaggaccatgtcatga

SEQ ID NO: 2209 - DNA, 37 bp, Artificial Sequence
  Synthetic oligonucleotide
tgctgttctcctggcgataggagattagccggacgga

SEQ ID NO: 2210 - DNA, 36 bp, Artificial Sequence
  Synthetic oligonucleotide
tgctaagagggctaaggccacacacttaataactta

SEQ ID NO: 2211 - DNA, 35 bp, Artificial Sequence; identical to SEQ ID NO: 2029
  Synthetic oligonucleotide

SEQ ID NO: 2212 - DNA, 38 bp, Artificial Sequence; identical to SEQ ID NO: 1609
  Synthetic oligonucleotide

SEQ ID NO: 2213 - DNA, 36 bp, Artificial Sequence
  Synthetic oligonucleotide
tggagtactagttccgaggacgtgagggaagactcg

SEQ ID NO: 2214 - DNA, 35 bp, Artificial Sequence
  Synthetic oligonucleotide
tggtccctggttccacttcattgagagcagagcat

SEQ ID NO: 2215 - DNA, 36 bp, Artificial Sequence
  Synthetic oligonucleotide
tgctcggatcttcgattcgtgccgcctgacaaatca

SEQ ID NO: 2216 - DNA, 35 bp, Artificial Sequence; identical to SEQ ID NO: 1644
  Synthetic oligonucleotide

SEQ ID NO: 2217 - DNA, 38 bp, Artificial Sequence
  Synthetic oligonucleotide
ttacgatgctcaagggtcccgttcgttcacagatatga

SEQ ID NO: 2218 - DNA, 38 bp, Artificial Sequence
  Synthetic oligonucleotide
ttacaaaccccggtgctctaaagttatcgatctcttga

SEQ ID NO: 2219 - DNA, 35 bp, Artificial Sequence
  Synthetic oligonucleotide
tgttggggggttagcacgggtttatgggttgcttc

SEQ ID NO: 2220 - DNA, 35 bp, Artificial Sequence
  Synthetic oligonucleotide
ttgcagtggagtaagccctgaccgaggagcgacga

SEQ ID NO: 2221 - DNA, 36 bp, Artificial Sequence
  Synthetic oligonucleotide
ttctcgcctacatctatctcaatattgtcctaccga

SEQ ID NO: 2222 - DNA, 36 bp, Artificial Sequence
  Synthetic oligonucleotide
ttgacatgcgatgtgcacagttagttaatttcaaca

SEQ ID NO: 2223 - DNA, 37 bp, Artificial Sequence
  Synthetic oligonucleotide
ttctatttactaaatacaacctttgtagcagacaaga

SEQ ID NO: 2224 - DNA, 36 bp, Artificial Sequence
  Synthetic oligonucleotide
ttccacacttcactgtacccactcttaccagccaca

SEQ ID NO: 2225 - DNA, 36 bp, Artificial Sequence
  Synthetic oligonucleotide
ttcctctagcctccgactggcgtgtgactctaaaga

SEQ ID NO: 2226 - DNA, 35 bp, Artificial Sequence
  Synthetic oligonucleotide
tttccgctatagtgcttctggtacgacgcgtacgg

SEQ ID NO: 2227 - DNA, 38 bp, Artificial Sequence
  Synthetic oligonucleotide
tttatactcatacccgaactgttccacaccgcaactga

SEQ ID NO: 2228 - DNA, 38 bp, Artificial Sequence
  Synthetic oligonucleotide
tttattcgccctttgttgacctacaccacatcacttga

SEQ ID NO: 2229 - DNA, 35 bp, Artificial Sequence; identical to SEQ ID NO: 1605
  Synthetic oligonucleotide

SEQ ID NO: 2230 - DNA, 38 bp, Artificial Sequence
  Synthetic oligonucleotide
ttgtagtttggccctttcgagggccgttgcctggttga

SEQ ID NO: 2231 - DNA, 38 bp, Artificial Sequence
  Synthetic oligonucleotide
tttttgttccataggtacggtctccggaggaatcgtga

SEQ ID NO: 2232 - DNA, 38 bp, Artificial Sequence
  Synthetic oligonucleotide
ttttgctaacgcgacggaggcgccgagagctatgctga

SEQ ID NO: 2233 - DNA, 35 bp, Artificial Sequence; identical to SEQ ID NO: 1599
  Synthetic oligonucleotide

SEQ ID NO: 2234 - DNA, 37 bp, Artificial Sequence; identical to SEQ ID NO: 1649
  Synthetic oligonucleotide

SEQ ID NO: 2235 - DNA, 36 bp, Artificial Sequence; identical to SEQ ID NO: 1651
  Synthetic oligonucleotide

SEQ ID NO: 2236 - DNA, 36 bp, Artificial Sequence; identical to SEQ ID NO: 1652
  Synthetic oligonucleotide

SEQ ID NO: 2237 - DNA, 37 bp, Artificial Sequence
  Synthetic oligonucleotide
aacgcctaactggacagaaaaatcgtacgctaccaga

SEQ ID NO: 2238 - DNA, 38 bp, Artificial Sequence; identical to SEQ ID NO: 1653
  Synthetic oligonucleotide

SEQ ID NO: 2239 - DNA, 38 bp, Artificial Sequence; identical to SEQ ID NO: 1792
  Synthetic oligonucleotide

SEQ ID NO: 2240 - DNA, 35 bp, Artificial Sequence
  Synthetic oligonucleotide
tggactggtcgtggggtgtgaacgaatccaatgtg

SEQ ID NO: 2241 - DNA, 38 bp, Artificial Sequence; identical to SEQ ID NO: 1731
  Synthetic oligonucleotide

SEQ ID NO: 2242 - DNA, 36 bp, Artificial Sequence
  Synthetic oligonucleotide
tgcaccctacccatttagatgtatcagccacgggca

SEQ ID NO: 2243 - DNA, 36 bp, Artificial Sequence
  Synthetic oligonucleotide
aacccgtagtagcacaccctgtctaacccaaatcaa

SEQ ID NO: 2244 - DNA, 35 bp, Artificial Sequence
  Synthetic oligonucleotide
aaacgcgatcttacatcattacaatccctcaaccc

SEQ ID NO: 2245 - DNA, 35 bp, Artificial Sequence
  Synthetic oligonucleotide
aaatcccatcgagcccttaacccagaccaactacg

SEQ ID NO: 2246 - DNA, 38 bp, Artificial Sequence
  Synthetic oligonucleotide
aagaacatgagactgaatatcgtacgcgagtaaaatga

SEQ ID NO: 2247 - DNA, 35 bp, Artificial Sequence
  Synthetic oligonucleotide
aagagtataggtccgagggaggacctactaattac

SEQ ID NO: 2248 - DNA, 38 bp, Artificial Sequence
  Synthetic oligonucleotide
aatttcggttacaccccgctctctatcactatacgtga

SEQ ID NO: 2249 - DNA, 37 bp, Artificial Sequence
  Synthetic oligonucleotide
accactagagtcctcaagaactcatccacccacctga

SEQ ID NO: 2250 - DNA, 35 bp, Artificial Sequence
  Synthetic oligonucleotide
acggtatttgttttttcgattgatggggaagtata

SEQ ID NO: 2251 - DNA, 37 bp, Artificial Sequence
  Synthetic oligonucleotide
accggcgaataacgccaaagcctgcgactggccttga

SEQ ID NO: 2252 - DNA, 35 bp, Artificial Sequence
  Synthetic oligonucleotide
acgcttttaaaaccatacactcgataactataccc

SEQ ID NO: 2253 - DNA, 36 bp, Artificial Sequence
  Synthetic oligonucleotide
accctactattaacccatcaaaagttcgctacccta

SEQ ID NO: 2254 - DNA, 36 bp, Artificial Sequence
  Synthetic oligonucleotide
acgcccatcgtttcgggcctttgtccatttcataca

SEQ ID NO: 2255 - DNA, 35 bp, Artificial Sequence
  Synthetic oligonucleotide
accttcccttcaacgggtgtattccggcgggtagc

SEQ ID NO: 2256 - DNA, 36 bp, Artificial Sequence
  Synthetic oligonucleotide
acttcacccacacaataccatcatcgataactcaaa

SEQ ID NO: 2257 - DNA, 35 bp, Artificial Sequence
  Synthetic oligonucleotide
agcggctaatcactgaagtagccccaggttttgaa

SEQ ID NO: 2258 - DNA, 37 bp, Artificial Sequence
  Synthetic oligonucleotide
agcaggcccaacggcctctgggttagtatccgcgtga

SEQ ID NO: 2259 - DNA, 36 bp, Artificial Sequence
  Synthetic oligonucleotide
agccgatccttgtccccgttgaaggccggatcgaaa

SEQ ID NO: 2260 - DNA, 38 bp, Artificial Sequence
  Synthetic oligonucleotide
aggcatctcaagcgctcggaggtacgcactatttctga

SEQ ID NO: 2261 - DNA, 35 bp, Artificial Sequence
  Synthetic oligonucleotide
agagacggcttcaacgcggctttcgggctctcttc

SEQ ID NO: 2262 - DNA, 35 bp, Artificial Sequence
  Synthetic oligonucleotide
agtacccccttatccctggggcctcccggggtacc

SEQ ID NO: 2263 - DNA, 36 bp, Artificial Sequence
  Synthetic oligonucleotide
atcaacaccattccctatatccaacactaaacgtaa

SEQ ID NO: 2264 - DNA, 37 bp, Artificial Sequence
  Synthetic oligonucleotide
agtttctcgacaggggcactctggccacgtggctgga

SEQ ID NO: 2265 - DNA, 35 bp, Artificial Sequence
  Synthetic oligonucleotide
aggggatactcagaacccgatgtaaatcttaagaa

SEQ ID NO: 2266 - DNA, 37 bp, Artificial Sequence
  Synthetic oligonucleotide
atcttcccaccacttgtgccttatcattgccccccga

SEQ ID NO: 2267 - DNA, 35 bp, Artificial Sequence; identical to SEQ ID NO: 1892
  Synthetic oligonucleotide

SEQ ID NO: 2268 - DNA, 35 bp, Artificial Sequence
  Synthetic oligonucleotide
ccagctagaccagacgaatgtggaactgaatctgc

SEQ ID NO: 2269 - DNA, 35 bp, Artificial Sequence
  Synthetic oligonucleotide
ccctaaaagcgacccactcagcggatttgacttgc

SEQ ID NO: 2270 - DNA, 35 bp, Artificial Sequence
  Synthetic oligonucleotide
ccaccccaccgagaggggctcatggcatacgctga

SEQ ID NO: 2271 - DNA, 36 bp, Artificial Sequence
  Synthetic oligonucleotide
cccgggaacacggtccgttcgtaggagaacgaccaa

SEQ ID NO: 2272 - DNA, 38 bp, Artificial Sequence
  Synthetic oligonucleotide
ccatgctctccggaggccgttttacggagggagcgtga

SEQ ID NO: 2273 - DNA, 36 bp, Artificial Sequence; identical to SEQ ID NO: 1651
  Synthetic oligonucleotide

SEQ ID NO: 2274 - DNA, 37 bp, Artificial Sequence
  Synthetic oligonucleotide
cgcttccgctacgtaccccccgggcgttcgccttgga

SEQ ID NO: 2275 - DNA, 37 bp, Artificial Sequence
  Synthetic oligonucleotide
ctcaaagcaacttgctggtgccagcaccgaagtccga

SEQ ID NO: 2276 - DNA, 38 bp, Artificial Sequence
  Synthetic oligonucleotide
ccttacatttatgttgaggcccccggtaattattgtga

SEQ ID NO: 2277 - DNA, 35 bp, Artificial Sequence
  Synthetic oligonucleotide
ctggtaccctgcgattcgggtctcgacttggttcc

SEQ ID NO: 2278 - DNA, 37 bp, Artificial Sequence
  Synthetic oligonucleotide
gaacgtacgccttcctcgtaataattggaaccttcta

SEQ ID NO: 2279 - DNA, 35 bp, Artificial Sequence
  Synthetic oligonucleotide
cttcgccatcttccggtcggcgaaaaacaggccac

SEQ ID NO: 2280 - DNA, 35 bp, Artificial Sequence; identical to SEQ ID NO: 1918
  Synthetic oligonucleotide

SEQ ID NO: 2281 - DNA, 37 bp, Artificial Sequence
  Synthetic oligonucleotide
gaggacattggaccgccccatacgaacgccactctga

SEQ ID NO: 2282 - DNA, 36 bp, Artificial Sequence
  Synthetic oligonucleotide
gagtacgactaattatcttaacaacatttatgaaca

SEQ ID NO: 2283 - DNA, 35 bp, Artificial Sequence
  Synthetic oligonucleotide
gagtagttgcatcgaagcggaggcttttccggatc

SEQ ID NO: 2284 - DNA, 36 bp, Artificial Sequence
  Synthetic oligonucleotide
gcactgtccccggttttctactaactctgatcttga

SEQ ID NO: 2285 - DNA, 38 bp, Artificial Sequence
  Synthetic oligonucleotide
gcgtcctgcactgttttacagttcttggtaatatttga

SEQ ID NO: 2286 - DNA, 37 bp, Artificial Sequence
  Synthetic oligonucleotide
ggcacacacctagcctgaaaggtcctttaacattgga

SEQ ID NO: 2287 - DNA, 37 bp, Artificial Sequence
  Synthetic oligonucleotide
ggcccagtactcacgctagaccctcgaggggactcga

SEQ ID NO: 2288 - DNA, 35 bp, Artificial Sequence
  Synthetic oligonucleotide
ggacccgtaccgacacctatagccttcccccagag

SEQ ID NO: 2289 - DNA, 37 bp, Artificial Sequence
  Synthetic oligonucleotide
ggtctagcgggtacaccttctggggttcggtttgtga

SEQ ID NO: 2290 - DNA, 37 bp, Artificial Sequence; identical to SEQ ID NO: 1939
  Synthetic oligonucleotide

SEQ ID NO: 2291 - DNA, 37 bp, Artificial Sequence
  Synthetic oligonucleotide
gggaactcgcaaaatttcttgaccccaaggtacccga

SEQ ID NO: 2292 - DNA, 37 bp, Artificial Sequence
  Synthetic oligonucleotide
ggtccttgagcatcaaatcgctaagggggtccgcaga

SEQ ID NO: 2293 - DNA, 37 bp, Artificial Sequence
  Synthetic oligonucleotide
gtctggtttttatattcagagccctgtttgggttaga

SEQ ID NO: 2294 - DNA, 35 bp, Artificial Sequence
  Synthetic oligonucleotide
taaggatagcgctcggcctttattgatacttgttt

SEQ ID NO: 2295 - DNA, 38 bp, Artificial Sequence
  Synthetic oligonucleotide
taaccgcatcactttcacttgacactaatacctcatga

SEQ ID NO: 2296 - DNA, 36 bp, Artificial Sequence
  Synthetic oligonucleotide
taatatccctgctctcgaacacttcgctttaaacta

SEQ ID NO: 2297 - DNA, 36 bp, Artificial Sequence; identical to SEQ ID NO: 1719
  Synthetic oligonucleotide

SEQ ID NO: 2298 - DNA, 36 bp, Artificial Sequence
  Synthetic oligonucleotide
gttccgctccagggaacagaggatcagggagttcga

SEQ ID NO: 2299 - DNA, 37 bp, Artificial Sequence
  Synthetic oligonucleotide
tatatccgcatcccgaagcatagatctcaagtactga

SEQ ID NO: 2300 - DNA, 38 bp, Artificial Sequence
  Synthetic oligonucleotide
tatacacccgaaaagcgggttatcaaaaattatcatga

SEQ ID NO: 2301 - DNA, 35 bp, Artificial Sequence
  Synthetic oligonucleotide
tactatcttctagttcaacagccacttatgaccca

SEQ ID NO: 2302 - DNA, 35 bp, Artificial Sequence
  Synthetic oligonucleotide
tacgccccttaacctctaaccagcgagggtagttc

SEQ ID NO: 2303 - DNA, 36 bp, Artificial Sequence
  Synthetic oligonucleotide
tcaacgaccgcgaggttgaacgacgtggggactgta

SEQ ID NO: 2304 - DNA, 38 bp, Artificial Sequence
  Synthetic oligonucleotide
tattatgttcacggccggaggggggccgggggatgcga

SEQ ID NO: 2305 - DNA, 36 bp, Artificial Sequence
  Synthetic oligonucleotide
tcgcatacaacaaaattacgcctaaccataacacca

SEQ ID NO: 2306 - DNA, 38 bp, Artificial Sequence
  Synthetic oligonucleotide
tgaagtactcgtaagttttatagtttttcattctatga

SEQ ID NO: 2307 - DNA, 36 bp, Artificial Sequence
  Synthetic oligonucleotide
tgacaaaagtcccctgaggggtggactcgtgaccca

SEQ ID NO: 2308 - DNA, 35 bp, Artificial Sequence
  Synthetic oligonucleotide
tgcgggtgcatgccgagtgagccgaacgacccatc

SEQ ID NO: 2309 - DNA, 38 bp, Artificial Sequence
  Synthetic oligonucleotide
tggccggggtttggccccagaaagatacgccggggtga

SEQ ID NO: 2310 - DNA, 36 bp, Artificial Sequence
  Synthetic oligonucleotide
tggacctactacgcttgggcaacgcgggggccccta

SEQ ID NO: 2311 - DNA, 38 bp, Artificial Sequence
  Synthetic oligonucleotide
tggacgattttgccaccgttagtacaacccgggggtga

SEQ ID NO: 2312 - DNA, 35 bp, Artificial Sequence
  Synthetic oligonucleotide
tgtagcccaggagaaaccctaccccaacggacgcg

SEQ ID NO: 2313 - DNA, 36 bp, Artificial Sequence
  Synthetic oligonucleotide
tgtggcgagggccgcctccaggcatgaaatgtatca

SEQ ID NO: 2314 - DNA, 38 bp, Artificial Sequence
  Synthetic oligonucleotide
tgtttgcttcatagtaacgttgagactgcataaactga

SEQ ID NO: 2315 - DNA, 35 bp, Artificial Sequence
  Synthetic oligonucleotide
tgttagttccactttccgataatccgcctccctta

SEQ ID NO: 2316 - DNA, 35 bp, Artificial Sequence
  Synthetic oligonucleotide
ttctcgacggccttccaggcgggagacaaagctgc

SEQ ID NO: 2317 - DNA, 38 bp, Artificial Sequence
  Synthetic oligonucleotide
ttcatggacgaaacgggcggcggacatttattcgctga

SEQ ID NO: 2318 - DNA, 38 bp, Artificial Sequence
  Synthetic oligonucleotide
tttgctccggtgtttgaccctcgcagtccggagagtga

SEQ ID NO: 2319 - DNA, 35 bp, Artificial Sequence; identical to SEQ ID NO: 2007
  Synthetic oligonucleotide

SEQ ID NO: 2320 - DNA, 36 bp, Artificial Sequence; identical to SEQ ID NO: 1590
  Synthetic oligonucleotide

SEQ ID NO: 2321 - DNA, 35 bp, Artificial Sequence; identical to SEQ ID NO: 1591
  Synthetic oligonucleotide

SEQ ID NO: 2322 - DNA, 38 bp, Artificial Sequence; identical to SEQ ID NO: 2016
  Synthetic oligonucleotide

SEQ ID NO: 2323 - DNA, 37 bp, Artificial Sequence
  Synthetic oligonucleotide
aacgcgctggtcttcgtgtattgtttcgcgctaagga

SEQ ID NO: 2324 - DNA, 35 bp, Artificial Sequence
  Synthetic oligonucleotide
aactatcattcatcttggtgtgatctacctttgtt

SEQ ID NO: 2325 - DNA, 37 bp, Artificial Sequence; identical to SEQ ID NO: 2005
  Synthetic oligonucleotide

SEQ ID NO: 2326 - DNA, 36 bp, Artificial Sequence
  Synthetic oligonucleotide
cttctatatatctcattcttccggtttattcaatca

SEQ ID NO: 2327 - DNA, 36 bp, Artificial Sequence; identical to SEQ ID NO: 1586
  Synthetic oligonucleotide

SEQ ID NO: 2328 - DNA, 37 bp, Artificial Sequence; identical to SEQ ID NO: 1595
  Synthetic oligonucleotide

SEQ ID NO: 2329 - DNA, 35 bp, Artificial Sequence; identical to SEQ ID NO: 1740
  Synthetic oligonucleotide

SEQ ID NO: 2330 - DNA, 35 bp, Artificial Sequence
  Synthetic oligonucleotide
acgcttcttttacttagctaaccattattcattgt

SEQ ID NO: 2331 - DNA, 37 bp, Artificial Sequence; identical to SEQ ID NO: 1587
  Synthetic oligonucleotide

SEQ ID NO: 2332 - DNA, 38 bp, Artificial Sequence; identical to SEQ ID NO: 2012
  Synthetic oligonucleotide

SEQ ID NO: 2333 - DNA, 35 bp, Artificial Sequence; identical to SEQ ID NO: 2014
  Synthetic oligonucleotide

SEQ ID NO: 2334 - DNA, 38 bp, Artificial Sequence; identical to SEQ ID NO: 1596
  Synthetic oligonucleotide

SEQ ID NO: 2335 - DNA, 35 bp, Artificial Sequence; identical to SEQ ID NO: 2028
  Synthetic oligonucleotide

SEQ ID NO: 2336 - DNA, 35 bp, Artificial Sequence; identical to SEQ ID NO: 1644
  Synthetic oligonucleotide

SEQ ID NO: 2337 - DNA, 36 bp, Artificial Sequence; identical to SEQ ID NO: 1638
  Synthetic oligonucleotide

SEQ ID NO: 2338 - DNA, 36 bp, Artificial Sequence; identical to SEQ ID NO: 2038
  Synthetic oligonucleotide

SEQ ID NO: 2339 - DNA, 35 bp, Artificial Sequence; identical to SEQ ID NO: 1606
  Synthetic oligonucleotide

SEQ ID NO: 2340 - DNA, 35 bp, Artificial Sequence; identical to SEQ ID NO: 2045
  Synthetic oligonucleotide

SEQ ID NO: 2341 - DNA, 38 bp, Artificial Sequence
  Synthetic oligonucleotide
ttctgccggtttttacggtcaaattctagatagtttga

SEQ ID NO: 2342 - DNA, 36 bp, Artificial Sequence; identical to SEQ ID NO: 1769
  Synthetic oligonucleotide

SEQ ID NO: 2343 - DNA, 38 bp, Artificial Sequence; identical to SEQ ID NO: 1601
  Synthetic oligonucleotide

SEQ ID NO: 2344 - DNA, 36 bp, Artificial Sequence; identical to SEQ ID NO: 1604
  Synthetic oligonucleotide

SEQ ID NO: 2345 - DNA, 35 bp, Artificial Sequence; identical to SEQ ID NO: 1605
  Synthetic oligonucleotide

SEQ ID NO: 2346 - DNA, 35 bp, Artificial Sequence; identical to SEQ ID NO: 2042
  Synthetic oligonucleotide

SEQ ID NO: 2347 - DNA, 36 bp, Artificial Sequence; identical to SEQ ID NO: 2043
  Synthetic oligonucleotide

SEQ ID NO: 2348 - DNA, 36 bp, Artificial Sequence; identical to SEQ ID NO: 2047
  Synthetic oligonucleotide

SEQ ID NO: 2349 - DNA, 36 bp, Artificial Sequence; identical to SEQ ID NO: 1611
  Synthetic oligonucleotide

SEQ ID NO: 2350 - DNA, 36 bp, Artificial Sequence; identical to SEQ ID NO: 1750
  Synthetic oligonucleotide

SEQ ID NO: 2351 - DNA, 36 bp, Artificial Sequence; identical to SEQ ID NO: 1598
  Synthetic oligonucleotide

SEQ ID NO: 2352 - DNA, 35 bp, Artificial Sequence; identical to SEQ ID NO: 1599
  Synthetic oligonucleotide

SEQ ID NO: 2353 - DNA, 37 bp, Artificial Sequence; identical to SEQ ID NO: 1649
  Synthetic oligonucleotide

SEQ ID NO: 2354 - DNA, 36 bp, Artificial Sequence; identical to SEQ ID NO: 1603
  Synthetic oligonucleotide

SEQ ID NO: 2355 - DNA, 36 bp, Artificial Sequence; identical to SEQ ID NO: 2048
  Synthetic oligonucleotide

SEQ ID NO: 2356 - DNA, 38 bp, Artificial Sequence; identical to SEQ ID NO: 1609
  Synthetic oligonucleotide

SEQ ID NO: 2357 - DNA, 35 bp, Artificial Sequence
  Synthetic oligonucleotide
aaatcccaacgagcccttaacccagaccaactaca

SEQ ID NO: 2358 - DNA, 37 bp, Artificial Sequence; identical to SEQ ID NO: 2055
  Synthetic oligonucleotide

SEQ ID NO: 2359 - DNA, 37 bp, Artificial Sequence
  Synthetic oligonucleotide
aacgtagtgaggtattccgcaccccctttattcgtga

SEQ ID NO: 2360 - DNA, 36 bp, Artificial Sequence
  Synthetic oligonucleotide
aacccaattcacatacactctcacccacactaaaca

SEQ ID NO: 2361 - DNA, 38 bp, Artificial Sequence
  Synthetic oligonucleotide
aaaaccgctcgcttaagctttctttgactttttgatga

SEQ ID NO: 2362 - DNA, 36 bp, Artificial Sequence
  Synthetic oligonucleotide
aatgcacaaccgcgctgaaaatcacctttatcgaaa

SEQ ID NO: 2363 - DNA, 37 bp, Artificial Sequence
  Synthetic oligonucleotide
aattgatctttttgtttacgaattcgtattccattga

SEQ ID NO: 2364 - DNA, 38 bp, Artificial Sequence
  Synthetic oligonucleotide
aatcaccacaaatactttcgcctatctcgcttatctga

SEQ ID NO: 2365 - DNA, 36 bp, Artificial Sequence
  Synthetic oligonucleotide
aacttgtcttatgctctccaccttacctattaacaa

SEQ ID NO: 2366 - DNA, 37 bp, Artificial Sequence
  Synthetic oligonucleotide
aactcctgatatcgtttcttcgtttccgccaattcta

SEQ ID NO: 2367 - DNA, 35 bp, Artificial Sequence; identical to SEQ ID NO: 2061
  Synthetic oligonucleotide

SEQ ID NO: 2368 - DNA, 38 bp, Artificial Sequence; identical to SEQ ID NO: 2024
  Synthetic oligonucleotide

SEQ ID NO: 2369 - DNA, 36 bp, Artificial Sequence
  Synthetic oligonucleotide
accgggaacatttctgttgtttcatttcatcactaa

SEQ ID NO: 2370 - DNA, 35 bp, Artificial Sequence; identical to SEQ ID NO: 2330
  Synthetic oligonucleotide

SEQ ID NO: 2371 - DNA, 37 bp, Artificial Sequence; identical to SEQ ID NO: 2067
  Synthetic oligonucleotide

SEQ ID NO: 2372 - DNA, 35 bp, Artificial Sequence
  Synthetic oligonucleotide
accgacgcactctcctttctaaaatctatctactt

SEQ ID NO: 2373 - DNA, 35 bp, Artificial Sequence
  Synthetic oligonucleotide
acgttaatttcccaaaaacgatcccactttgaaca

SEQ ID NO: 2374 - DNA, 36 bp, Artificial Sequence
  Synthetic oligonucleotide
actcgcccttcacgactttatcaaaatgtactttca

SEQ ID NO: 2375 - DNA, 38 bp, Artificial Sequence; identical to SEQ ID NO: 2071
  Synthetic oligonucleotide

SEQ ID NO: 2376 - DNA, 35 bp, Artificial Sequence; identical to SEQ ID NO: 1597
  Synthetic oligonucleotide

SEQ ID NO: 2377 - DNA, 36 bp, Artificial Sequence; identical to SEQ ID NO: 1617
  Synthetic oligonucleotide

SEQ ID NO: 2378 - DNA, 36 bp, Artificial Sequence
  Synthetic oligonucleotide
acttcgcccacacaataccattatcgataactcaaa

SEQ ID NO: 2379 - DNA, 35 bp, Artificial Sequence; identical to SEQ ID NO: 1591
  Synthetic oligonucleotide

SEQ ID NO: 2380 - DNA, 36 bp, Artificial Sequence; identical to SEQ ID NO: 1590
  Synthetic oligonucleotide

SEQ ID NO: 2381 - DNA, 38 bp, Artificial Sequence; identical to SEQ ID NO: 2023
  Synthetic oligonucleotide

SEQ ID NO: 2382 - DNA, 36 bp, Artificial Sequence; identical to SEQ ID NO: 1586
  Synthetic oligonucleotide

SEQ ID NO: 2383 - DNA, 35 bp, Artificial Sequence; identical to SEQ ID NO: 1620
  Synthetic oligonucleotide

SEQ ID NO: 2384 - DNA, 35 bp, Artificial Sequence
  Synthetic oligonucleotide
atatgcccgctccctactcaatatcttcccataca

SEQ ID NO: 2385 - DNA, 35 bp, Artificial Sequence; identical to SEQ ID NO: 1594
  Synthetic oligonucleotide

SEQ ID NO: 2386 - DNA, 37 bp, Artificial Sequence
  Synthetic oligonucleotide
atgcattatcccagctttaaacgctctacccaccgaa

SEQ ID NO: 2387 - DNA, 36 bp, Artificial Sequence; identical to SEQ ID NO: 2092
  Synthetic oligonucleotide

SEQ ID NO: 2388 - DNA, 35 bp, Artificial Sequence
  Synthetic oligonucleotide
atctgcttgtaagtccccgtgtatacctgttcagt

SEQ ID NO: 2389 - DNA, 35 bp, Artificial Sequence
  Synthetic oligonucleotide
atcactggagtgatagtctgggccctgaaactcct

SEQ ID NO: 2390 - DNA, 36 bp, Artificial Sequence
  Synthetic oligonucleotide
atcaccgtccttatcatacccacttcgttttttata

SEQ ID NO: 2391 - DNA, 35 bp, Artificial Sequence; identical to SEQ ID NO: 1740
  Synthetic oligonucleotide

SEQ ID NO: 2392 - DNA, 37 bp, Artificial Sequence; identical to SEQ ID NO: 2094
  Synthetic oligonucleotide

SEQ ID NO: 2393 - DNA, 36 bp, Artificial Sequence; identical to SEQ ID NO: 2098
  Synthetic oligonucleotide

SEQ ID NO: 2394 - DNA, 37 bp, Artificial Sequence; identical to SEQ ID NO: 1587
  Synthetic oligonucleotide

SEQ ID NO: 2395 - DNA, 38 bp, Artificial Sequence; identical to SEQ ID NO: 2100
  Synthetic oligonucleotide

SEQ ID NO: 2396 - DNA, 35 bp, Artificial Sequence
  Synthetic oligonucleotide
ccagcacactgacttttccttacccacctcctttc

SEQ ID NO: 2397 - DNA, 38 bp, Artificial Sequence
  Synthetic oligonucleotide
ccccgccatggtttcaaatggctgaagctatctattga

SEQ ID NO: 2398 - DNA, 38 bp, Artificial Sequence
  Synthetic oligonucleotide
ccggtatctgcactcgtttggaatcgaccaacccctga

SEQ ID NO: 2399 - DNA, 37 bp, Artificial Sequence
  Synthetic oligonucleotide
ccgtctactgcaacaggaggccaccacggtcttccga

SEQ ID NO: 2400 - DNA, 37 bp, Artificial Sequence
  Synthetic oligonucleotide
cgctcttcttactttattcaatatggtcataaattga

SEQ ID NO: 2401 - DNA, 37 bp, Artificial Sequence
  Synthetic oligonucleotide
cgtttctttatcccaaagtcattcgcatgccctttga

SEQ ID NO: 2402 - DNA, 38 bp, Artificial Sequence; identical to SEQ ID NO: 1596
  Synthetic oligonucleotide

SEQ ID NO: 2403 - DNA, 35 bp, Artificial Sequence
  Synthetic oligonucleotide
cgcgcctccttccccgatgatatgccactgccgca

SEQ ID NO: 2404 - DNA, 35 bp, Artificial Sequence; identical to SEQ ID NO: 2114
  Synthetic oligonucleotide

SEQ ID NO: 2405 - DNA, 37 bp, Artificial Sequence
  Synthetic oligonucleotide
cgcttcttgggcaggaggcgacacaggttcatattga

SEQ ID NO: 2406 - DNA, 35 bp, Artificial Sequence; identical to SEQ ID NO: 2120
  Synthetic oligonucleotide

SEQ ID NO: 2407 - DNA, 37 bp, Artificial Sequence
  Synthetic oligonucleotide
ctgtcccttgtaaggattattcgtaggtatttagtga

SEQ ID NO: 2408 - DNA, 37 bp, Artificial Sequence
  Synthetic oligonucleotide
ctgcggtcacctgcatagtaattaataatatacgtga

SEQ ID NO: 2409 - DNA, 37 bp, Artificial Sequence
  Synthetic oligonucleotide
cttcgctaaatggctgggggaatcatactgccggaga

SEQ ID NO: 2410 - DNA, 35 bp, Artificial Sequence
  Synthetic oligonucleotide
ctcctgcagatcttggtacctcttgttctttcata

SEQ ID NO: 2411 - DNA, 37 bp, Artificial Sequence; identical to SEQ ID NO: 1595
  Synthetic oligonucleotide

SEQ ID NO: 2412 - DNA, 35 bp, Artificial Sequence
  Synthetic oligonucleotide
gaggacttttacttatcaaccccacctttcgaaca

SEQ ID NO: 2413 - DNA, 35 bp, Artificial Sequence
  Synthetic oligonucleotide
gagtacttgactcttgtatattttttctccccctt

SEQ ID NO: 2414 - DNA, 37 bp, Artificial Sequence
  Synthetic oligonucleotide
gatcccgttccttttttaacgatctattttcttttga

SEQ ID NO: 2415 - DNA, 35 bp, Artificial Sequence; identical to SEQ ID NO: 2140
  Synthetic oligonucleotide

SEQ ID NO: 2416 - DNA, 35 bp, Artificial Sequence; identical to SEQ ID NO: 2014
  Synthetic oligonucleotide

SEQ ID NO: 2417 - DNA, 35 bp, Artificial Sequence; identical to SEQ ID NO: 1600
  Synthetic oligonucleotide

SEQ ID NO: 2418 - DNA, 36 bp, Artificial Sequence; identical to SEQ ID NO: 2143
  Synthetic oligonucleotide

SEQ ID NO: 2419 - DNA, 36 bp, Artificial Sequence; identical to SEQ ID NO: 2147
  Synthetic oligonucleotide

SEQ ID NO: 2420 - DNA, 36 bp, Artificial Sequence; identical to SEQ ID NO: 2151
  Synthetic oligonucleotide

SEQ ID NO: 2421 - DNA, 37 bp, Artificial Sequence
  Synthetic oligonucleotide
gcggaatagtccacgggacgctaagcgtggagctcga

SEQ ID NO: 2422 - DNA, 36 bp, Artificial Sequence
  Synthetic oligonucleotide
gcgtccactctatccttgctttaatacatcgttaaa

SEQ ID NO: 2423 - DNA, 38 bp, Artificial Sequence
  Synthetic oligonucleotide
gcctttccaggttcttcttttcgaccgtttatttttga

SEQ ID NO: 2424 - DNA, 38 bp, Artificial Sequence
  Synthetic oligonucleotide
ggccctggtggcaccaagccgcgagcccactcaactga

SEQ ID NO: 2425 - DNA, 35 bp, Artificial Sequence
  Synthetic oligonucleotide
ggtgcccaactggtgcttctccttctttgagacgt

SEQ ID NO: 2426 - DNA, 38 bp, Artificial Sequence
  Synthetic oligonucleotide
gggagtttttatcctacaatgtaaattatcatacttga

SEQ ID NO: 2427 - DNA, 38 bp, Artificial Sequence; identical to SEQ ID NO: 1601
  Synthetic oligonucleotide

SEQ ID NO: 2428 - DNA, 36 bp, Artificial Sequence
  Synthetic oligonucleotide
ggtcccactctgaccatcaattcacctaacttgtaa

SEQ ID NO: 2429 - DNA, 35 bp, Artificial Sequence; identical to SEQ ID NO: 1606
  Synthetic oligonucleotide

SEQ ID NO: 2430 - DNA, 37 bp, Artificial Sequence; identical to SEQ ID NO: 2166
  Synthetic oligonucleotide

SEQ ID NO: 2431 - DNA, 36 bp, Artificial Sequence; identical to SEQ ID NO: 1598
  Synthetic oligonucleotide

SEQ ID NO: 2432 - DNA, 38 bp, Artificial Sequence; identical to SEQ ID NO: 1772
  Synthetic oligonucleotide

SEQ ID NO: 2433 - DNA, 35 bp, Artificial Sequence
  Synthetic oligonucleotide
gtcgaaagcggagcgactctccgcacaaccccaag

SEQ ID NO: 2434 - DNA, 36 bp, Artificial Sequence; identical to SEQ ID NO: 1602
  Synthetic oligonucleotide

SEQ ID NO: 2435 - DNA, 36 bp, Artificial Sequence; identical to SEQ ID NO: 1603
  Synthetic oligonucleotide

SEQ ID NO: 2436 - DNA, 35 bp, Artificial Sequence
  Synthetic oligonucleotide
gttcagattttgctttgtgacctggtgtggggtct

SEQ ID NO: 2437 - DNA, 37 bp, Artificial Sequence; identical to SEQ ID NO: 2178
  Synthetic oligonucleotide

SEQ ID NO: 2438 - DNA, 36 bp, Artificial Sequence; identical to SEQ ID NO: 2048
  Synthetic oligonucleotide

SEQ ID NO: 2439 - DNA, 35 bp, Artificial Sequence; identical to SEQ ID NO: 1607
  Synthetic oligonucleotide

SEQ ID NO: 2440 - DNA, 36 bp, Artificial Sequence
  Synthetic oligonucleotide
tactctagtcagaggatctcttgcgatcaatatgga

SEQ ID NO: 2441 - DNA, 35 bp, Artificial Sequence
  Synthetic oligonucleotide
tactgtccttttcaattcttgtcttggttttatta

SEQ ID NO: 2442 - DNA, 35 bp, Artificial Sequence
  Synthetic oligonucleotide
tactcggccctactacacgaactcttttcaaatca

SEQ ID NO: 2443 - DNA, 35 bp, Artificial Sequence; identical to SEQ ID NO: 2186
  Synthetic oligonucleotide

SEQ ID NO: 2444 - DNA, 38 bp, Artificial Sequence
  Synthetic oligonucleotide
tattgtagcctgtacggcggctgcacctcgtacgttga

SEQ ID NO: 2445 - DNA, 35 bp, Artificial Sequence
  Synthetic oligonucleotide
tcactttgcccttttgtttcttcattaattccttc

SEQ ID NO: 2446 - DNA, 38 bp, Artificial Sequence
  Synthetic oligonucleotide
tcacgctcccggggttctatctatttcgttattcttga

SEQ ID NO: 2447 - DNA, 36 bp, Artificial Sequence; identical to SEQ ID NO: 1638
  Synthetic oligonucleotide

SEQ ID NO: 2448 - DNA, 36 bp, Artificial Sequence; identical to SEQ ID NO: 2038
  Synthetic oligonucleotide

SEQ ID NO: 2449 - DNA, 38 bp, Artificial Sequence; identical to SEQ ID NO: 1608
  Synthetic oligonucleotide

SEQ ID NO: 2450 - DNA, 35 bp, Artificial Sequence
  Synthetic oligonucleotide
tccatcatattcattattccatgcctacccatccc

SEQ ID NO: 2451 - DNA, 37 bp, Artificial Sequence; identical to SEQ ID NO: 1639
  Synthetic oligonucleotide

SEQ ID NO: 2452 - DNA, 38 bp, Artificial Sequence
  Synthetic oligonucleotide
tccccataatctccgtcctcattgcttccaaaatttga

SEQ ID NO: 2453 - DNA, 38 bp, Artificial Sequence
  Synthetic oligonucleotide
tcccctcgccactgacccatctactcgccaaatcttga

SEQ ID NO: 2454 - DNA, 38 bp, Artificial Sequence
  Synthetic oligonucleotide
tcgggcaataccctttcccatattatcttctttcctta

SEQ ID NO: 2455 - DNA, 36 bp, Artificial Sequence
  Synthetic oligonucleotide
tctcgggattttccgcgactactcgagcgctactca

SEQ ID NO: 2456 - DNA, 36 bp, Artificial Sequence
  Synthetic oligonucleotide
tcgcttccttgtacttcctattcccttttcaccaca

SEQ ID NO: 2457 - DNA, 36 bp, Artificial Sequence; identical to SEQ ID NO: 1604
  Synthetic oligonucleotide

SEQ ID NO: 2458 - DNA, 36 bp, Artificial Sequence
  Synthetic oligonucleotide
tcttcacgatatgcagtgaaaacaccacccaactta

SEQ ID NO: 2459 - DNA, 37 bp, Artificial Sequence
  Synthetic oligonucleotide
tctgcttgatggtgctttcagtttcttacttctacga

SEQ ID NO: 2460 - DNA, 35 bp, Artificial Sequence
  Synthetic oligonucleotide
tcttctgtaaccattttgttccggtttttttattt

SEQ ID NO: 2461 - DNA, 36 bp, Artificial Sequence
  Synthetic oligonucleotide
tgaagctccgaaggggtgcacttgccgacagtagta

SEQ ID NO: 2462 - DNA, 35 bp, Artificial Sequence
  Synthetic oligonucleotide
tgacgtctcctgttcggttaaccctgtgtgcctgt

SEQ ID NO: 2463 - DNA, 37 bp, Artificial Sequence
  Synthetic oligonucleotide
tgcccttcttcgtttactcttatccacattaccttga

SEQ ID NO: 2464 - DNA, 36 bp, Artificial Sequence; identical to SEQ ID NO: 1750
  Synthetic oligonucleotide

SEQ ID NO: 2465 - DNA, 36 bp, Artificial Sequence
  Synthetic oligonucleotide
tgacatatcgctcttacatcccctcacacaatttca

SEQ ID NO: 2466 - DNA, 35 bp, Artificial Sequence
  Synthetic oligonucleotide
tgctccgagtaccataaactaatttgaagctctac

SEQ ID NO: 2467 - DNA, 37 bp, Artificial Sequence; identical to SEQ ID NO: 2209
  Synthetic oligonucleotide

SEQ ID NO: 2468 - DNA, 36 bp, Artificial Sequence
  Synthetic oligonucleotide
tggaccggtcaaaggatggcaccggttcctctcaca

SEQ ID NO: 2469 - DNA, 38 bp, Artificial Sequence; identical to SEQ ID NO: 1609
  Synthetic oligonucleotide

SEQ ID NO: 2470 - DNA, 38 bp, Artificial Sequence
  Synthetic oligonucleotide
tgctttgtacaacgttggtgtttggcatttgctgttga

SEQ ID NO: 2471 - DNA, 38 bp, Artificial Sequence; identical to SEQ ID NO: 2218
  Synthetic oligonucleotide

SEQ ID NO: 2472 - DNA, 35 bp, Artificial Sequence
  Synthetic oligonucleotide
tgtgccactcgtgttcgaatttctgttccttatct

SEQ ID NO: 2473 - DNA, 37 bp, Artificial Sequence
  Synthetic oligonucleotide
tgttacgcccgtcctctatacaccaattacgatatga

SEQ ID NO: 2474 - DNA, 36 bp, Artificial Sequence
  Synthetic oligonucleotide
tgttaggcctttatttccattatcttaattgtttta

SEQ ID NO: 2475 - DNA, 35 bp, Artificial Sequence; identical to SEQ ID NO: 1644
  Synthetic oligonucleotide

SEQ ID NO: 2476 - DNA, 36 bp, Artificial Sequence
  Synthetic oligonucleotide
ttctgccggatacatttgattcaataactacttgta

SEQ ID NO: 2477 - DNA, 35 bp, Artificial Sequence
  Synthetic oligonucleotide
ttctgcttgcgagccgtccagttagggccgccacc

SEQ ID NO: 2478 - DNA, 38 bp, Artificial Sequence; identical to SEQ ID NO: 2341
  Synthetic oligonucleotide

SEQ ID NO: 2479 - DNA, 36 bp, Artificial Sequence
  Synthetic oligonucleotide
ttgcacgccccaatacacctaatctttatccataca

SEQ ID NO: 2480 - DNA, 38 bp, Artificial Sequence
  Synthetic oligonucleotide
ttcgttccggaccacccatttcctcaatcatatattga

SEQ ID NO: 2481 - DNA, 37 bp, Artificial Sequence
  Synthetic oligonucleotide
ttctgcgttttacgatgctcgatgtctgtgacatgga

SEQ ID NO: 2482 - DNA, 36 bp, Artificial Sequence
  Synthetic oligonucleotide
ttgctccgacctagtttactaaatttcaaccattga

SEQ ID NO: 2483 - DNA, 36 bp, Artificial Sequence
  Synthetic oligonucleotide
tttcattataccccatcgactttctctctagttcca

SEQ ID NO: 2484 - DNA, 35 bp, Artificial Sequence
  Synthetic oligonucleotide
ttgtcccaggcagtttccacgagaacgcgtacggt

SEQ ID NO: 2485 - DNA, 38 bp, Artificial Sequence
  Synthetic oligonucleotide
tttggacgtatcactccctaaccatttttttaccctga

SEQ ID NO: 2486 - DNA, 36 bp, Artificial Sequence; identical to SEQ ID NO: 1611
  Synthetic oligonucleotide

SEQ ID NO: 2487 - DNA, 35 bp, Artificial Sequence
  Synthetic oligonucleotide
tttcctgtttcttctttgtgtgtccatataatcga

SEQ ID NO: 2488 - DNA, 35 bp, Artificial Sequence; identical to SEQ ID NO: 1605
  Synthetic oligonucleotide

SEQ ID NO: 2489 - DNA, 36 bp, Artificial Sequence
  Synthetic oligonucleotide
tttaaacgtacgatattacttccgatccatacatta

SEQ ID NO: 2490 - DNA, 37 bp, Artificial Sequence; identical to SEQ ID NO: 1649
  Synthetic oligonucleotide

SEQ ID NO: 2491 - DNA, 35 bp, Artificial Sequence; identical to SEQ ID NO: 1599
  Synthetic oligonucleotide

SEQ ID NO: 2492 - DNA, 36 bp, Artificial Sequence; identical to SEQ ID NO: 1651
  Synthetic oligonucleotide

SEQ ID NO: 2493 - DNA, 36 bp, Artificial Sequence; identical to SEQ ID NO: 1652
  Synthetic oligonucleotide

SEQ ID NO: 2494 - DNA, 37 bp, Artificial Sequence; identical to SEQ ID NO: 2237
  Synthetic oligonucleotide

SEQ ID NO: 2495 - DNA, 38 bp, Artificial Sequence; identical to SEQ ID NO: 1653
  Synthetic oligonucleotide

SEQ ID NO: 2496 - DNA, 37 bp, Artificial Sequence
  Synthetic oligonucleotide
acaactatcaaataaacctgcgccctctatgaatgga

SEQ ID NO: 2497 - DNA, 36 bp, Artificial Sequence
  Synthetic oligonucleotide
gaccaatagacccggccaagactggagatgaaagta

SEQ ID NO: 2498 - DNA, 38 bp, Artificial Sequence; identical to SEQ ID NO: 1792
  Synthetic oligonucleotide

SEQ ID NO: 2499 - DNA, 36 bp, Artificial Sequence; identical to SEQ ID NO: 1661
  Synthetic oligonucleotide

SEQ ID NO: 2500 - DNA, 35 bp, Artificial Sequence
  Synthetic oligonucleotide
acggtatttgttttttcgattgatggggaagtaga

SEQ ID NO: 2501 - DNA, 38 bp, Artificial Sequence
  Synthetic oligonucleotide
ccacccgtacgaagccgcgttttctgagtgcctattga

SEQ ID NO: 2502 - DNA, 38 bp, Artificial Sequence; identical to SEQ ID NO: 1731
  Synthetic oligonucleotide

SEQ ID NO: 2503 - DNA, 35 bp, Artificial Sequence
  Synthetic oligonucleotide
ggccaatttgaatgagggttgtgaattatttaaga

SEQ ID NO: 2504 - DNA, 37 bp, Artificial Sequence
  Synthetic oligonucleotide
ggcctaaccatggggggtggtgattattatgaaggga

SEQ ID NO: 2505 - DNA, 36 bp, Artificial Sequence
  Synthetic oligonucleotide
ttcatcgcggggccgaggtaagcctaatcttccgta

SEQ ID NO: 2506 - DNA, 37 bp, Artificial Sequence
  Synthetic oligonucleotide
gtaactggtatcctaaaagaataggttcgtaccccga

SEQ ID NO: 2507 - DNA, 36 bp, Artificial Sequence; identical to SEQ ID NO: 2242
  Synthetic oligonucleotide

SEQ ID NO: 2508 - DNA, 36 bp, Artificial Sequence; identical to SEQ ID NO: 2243
  Synthetic oligonucleotide

SEQ ID NO: 2509 - DNA, 35 bp, Artificial Sequence; identical to SEQ ID NO: 2244
  Synthetic oligonucleotide

SEQ ID NO: 2510 - DNA, 35 bp, Artificial Sequence; identical to SEQ ID NO: 2245
  Synthetic oligonucleotide

SEQ ID NO: 2511 - DNA, 38 bp, Artificial Sequence; identical to SEQ ID NO: 2246
  Synthetic oligonucleotide

SEQ ID NO: 2512 - DNA, 35 bp, Artificial Sequence; identical to SEQ ID NO: 2247
  Synthetic oligonucleotide

SEQ ID NO: 2513 - DNA, 38 bp, Artificial Sequence; identical to SEQ ID NO: 2248
  Synthetic oligonucleotide

SEQ ID NO: 2514 - DNA, 37 bp, Artificial Sequence; identical to SEQ ID NO: 2249
  Synthetic oligonucleotide

SEQ ID NO: 2515 - DNA, 35 bp, Artificial Sequence; identical to SEQ ID NO: 2250
  Synthetic oligonucleotide

SEQ ID NO: 2516 - DNA, 37 bp, Artificial Sequence; identical to SEQ ID NO: 2251
  Synthetic oligonucleotide

SEQ ID NO: 2517 - DNA, 35 bp, Artificial Sequence; identical to SEQ ID NO: 2252
  Synthetic oligonucleotide

SEQ ID NO: 2518 - DNA, 36 bp, Artificial Sequence; identical to SEQ ID NO: 2253
  Synthetic oligonucleotide

SEQ ID NO: 2519 - DNA, 36 bp, Artificial Sequence; identical to SEQ ID NO: 2254
  Synthetic oligonucleotide

SEQ ID NO: 2520 - DNA, 35 bp, Artificial Sequence; identical to SEQ ID NO: 2255
  Synthetic oligonucleotide

SEQ ID NO: 2521 - DNA, 36 bp, Artificial Sequence; identical to SEQ ID NO: 2256
  Synthetic oligonucleotide

SEQ ID NO: 2522 - DNA, 35 bp, Artificial Sequence; identical to SEQ ID NO: 2257
  Synthetic oligonucleotide

SEQ ID NO: 2523 - DNA, 37 bp, Artificial Sequence; identical to SEQ ID NO: 2258
  Synthetic oligonucleotide

SEQ ID NO: 2524 - DNA, 36 bp, Artificial Sequence; identical to SEQ ID NO: 2259
  Synthetic oligonucleotide

SEQ ID NO: 2525 - DNA, 38 bp, Artificial Sequence; identical to SEQ ID NO: 2260
  Synthetic oligonucleotide

SEQ ID NO: 2526 - DNA, 35 bp, Artificial Sequence; identical to SEQ ID NO: 2261
  Synthetic oligonucleotide

SEQ ID NO: 2527 - DNA, 35 bp, Artificial Sequence; identical to SEQ ID NO: 2262
  Synthetic oligonucleotide

SEQ ID NO: 2528 - DNA, 36 bp, Artificial Sequence; identical to SEQ ID NO: 2263
  Synthetic oligonucleotide

SEQ ID NO: 2529 - DNA, 37 bp, Artificial Sequence; identical to SEQ ID NO: 2264
  Synthetic oligonucleotide

SEQ ID NO: 2530 - DNA, 35 bp, Artificial Sequence; identical to SEQ ID NO: 2265
  Synthetic oligonucleotide

SEQ ID NO: 2531 - DNA, 37 bp, Artificial Sequence; identical to SEQ ID NO: 2266
  Synthetic oligonucleotide

SEQ ID NO: 2532 - DNA, 35 bp, Artificial Sequence; identical to SEQ ID NO: 1892
  Synthetic oligonucleotide

SEQ ID NO: 2533 - DNA, 35 bp, Artificial Sequence; identical to SEQ ID NO: 2268
  Synthetic oligonucleotide

SEQ ID NO: 2534 - DNA, 35 bp, Artificial Sequence; identical to SEQ ID NO: 2269
  Synthetic oligonucleotide

SEQ ID NO: 2535 - DNA, 35 bp, Artificial Sequence; identical to SEQ ID NO: 2270
  Synthetic oligonucleotide

SEQ ID NO: 2536 - DNA, 36 bp, Artificial Sequence; identical to SEQ ID NO: 2271
  Synthetic oligonucleotide

SEQ ID NO: 2537 - DNA, 38 bp, Artificial Sequence; identical to SEQ ID NO: 2272
  Synthetic oligonucleotide

SEQ ID NO: 2538 - DNA, 36 bp, Artificial Sequence; identical to SEQ ID NO: 1651
  Synthetic oligonucleotide

SEQ ID NO: 2539 - DNA, 37 bp, Artificial Sequence; identical to SEQ ID NO: 2274
  Synthetic oligonucleotide

SEQ ID NO: 2540 - DNA, 37 bp, Artificial Sequence; identical to SEQ ID NO: 2275
  Synthetic oligonucleotide

SEQ ID NO: 2541 - DNA, 38 bp, Artificial Sequence; identical to SEQ ID NO: 2276
  Synthetic oligonucleotide

SEQ ID NO: 2542 - DNA, 35 bp, Artificial Sequence; identical to SEQ ID NO: 2277
  Synthetic oligonucleotide

SEQ ID NO: 2543 - DNA, 37 bp, Artificial Sequence; identical to SEQ ID NO: 2278
  Synthetic oligonucleotide

SEQ ID NO: 2544 - DNA, 35 bp, Artificial Sequence; identical to SEQ ID NO: 2279
  Synthetic oligonucleotide

SEQ ID NO: 2545 - DNA, 35 bp, Artificial Sequence; identical to SEQ ID NO: 1918
  Synthetic oligonucleotide

SEQ ID NO: 2546 - DNA, 37 bp, Artificial Sequence; identical to SEQ ID NO: 2281
  Synthetic oligonucleotide

SEQ ID NO: 2547 - DNA, 36 bp, Artificial Sequence; identical to SEQ ID NO: 2282
  Synthetic oligonucleotide

SEQ ID NO: 2548 - DNA, 35 bp, Artificial Sequence; identical to SEQ ID NO: 2283
  Synthetic oligonucleotide

SEQ ID NO: 2549 - DNA, 36 bp, Artificial Sequence; identical to SEQ ID NO: 2284
  Synthetic oligonucleotide

SEQ ID NO: 2550 - DNA, 38 bp, Artificial Sequence; identical to SEQ ID NO: 2285
  Synthetic oligonucleotide

SEQ ID NO: 2551 - DNA, 37 bp, Artificial Sequence; identical to SEQ ID NO: 2286
  Synthetic oligonucleotide

SEQ ID NO: 2552 - DNA, 37 bp, Artificial Sequence; identical to SEQ ID NO: 2287
  Synthetic oligonucleotide

SEQ ID NO: 2553 - DNA, 35 bp, Artificial Sequence; identical to SEQ ID NO: 2288
  Synthetic oligonucleotide

SEQ ID NO: 2554 - DNA, 37 bp, Artificial Sequence; identical to SEQ ID NO: 2289
  Synthetic oligonucleotide

SEQ ID NO: 2555 - DNA, 37 bp, Artificial Sequence; identical to SEQ ID NO: 1939
  Synthetic oligonucleotide

SEQ ID NO: 2556 - DNA, 37 bp, Artificial Sequence; identical to SEQ ID NO: 2291
  Synthetic oligonucleotide

SEQ ID NO: 2557 - DNA, 37 bp, Artificial Sequence; identical to SEQ ID NO: 2292
  Synthetic oligonucleotide

SEQ ID NO: 2558 - DNA, 37 bp, Artificial Sequence; identical to SEQ ID NO: 2293
  Synthetic oligonucleotide

SEQ ID NO: 2559 - DNA, 35 bp, Artificial Sequence; identical to SEQ ID NO: 2294
  Synthetic oligonucleotide

SEQ ID NO: 2560 - DNA, 38 bp, Artificial Sequence; identical to SEQ ID NO: 2295
  Synthetic oligonucleotide

SEQ ID NO: 2561 - DNA, 36 bp, Artificial Sequence; identical to SEQ ID NO: 2296
  Synthetic oligonucleotide

SEQ ID NO: 2562 - DNA, 36 bp, Artificial Sequence; identical to SEQ ID NO: 1719
  Synthetic oligonucleotide

SEQ ID NO: 2563 - DNA, 36 bp, Artificial Sequence; identical to SEQ ID NO: 2298
  Synthetic oligonucleotide

SEQ ID NO: 2564 - DNA, 37 bp, Artificial Sequence; identical to SEQ ID NO: 2299
  Synthetic oligonucleotide

SEQ ID NO: 2565 - DNA, 38 bp, Artificial Sequence; identical to SEQ ID NO: 2300
  Synthetic oligonucleotide

SEQ ID NO: 2566 - DNA, 35 bp, Artificial Sequence; identical to SEQ ID NO: 2301
  Synthetic oligonucleotide

SEQ ID NO: 2567 - DNA, 35 bp, Artificial Sequence; identical to SEQ ID NO: 2302
  Synthetic oligonucleotide

SEQ ID NO: 2568 - DNA, 36 bp, Artificial Sequence; identical to SEQ ID NO: 2303
  Synthetic oligonucleotide

SEQ ID NO: 2569 - DNA, 38 bp, Artificial Sequence; identical to SEQ ID NO: 2304
  Synthetic oligonucleotide

SEQ ID NO: 2570 - DNA, 36 bp, Artificial Sequence; identical to SEQ ID NO: 2305
  Synthetic oligonucleotide

SEQ ID NO: 2571 - DNA, 38 bp, Artificial Sequence; identical to SEQ ID NO: 2306
  Synthetic oligonucleotide

SEQ ID NO: 2572 - DNA, 36 bp, Artificial Sequence; identical to SEQ ID NO: 2307
  Synthetic oligonucleotide

SEQ ID NO: 2573 - DNA, 35 bp, Artificial Sequence; identical to SEQ ID NO: 2308
  Synthetic oligonucleotide

SEQ ID NO: 2574 - DNA, 38 bp, Artificial Sequence; identical to SEQ ID NO: 2309
  Synthetic oligonucleotide

SEQ ID NO: 2575 - DNA, 36 bp, Artificial Sequence; identical to SEQ ID NO: 2310
  Synthetic oligonucleotide

SEQ ID NO: 2576 - DNA, 38 bp, Artificial Sequence; identical to SEQ ID NO: 2311
  Synthetic oligonucleotide

SEQ ID NO: 2577 - DNA, 35 bp, Artificial Sequence; identical to SEQ ID NO: 2312
  Synthetic oligonucleotide

SEQ ID NO: 2578 - DNA, 36 bp, Artificial Sequence; identical to SEQ ID NO: 2313
  Synthetic oligonucleotide

SEQ ID NO: 2579 - DNA, 38 bp, Artificial Sequence; identical to SEQ ID NO: 2314
  Synthetic oligonucleotide

SEQ ID NO: 2580 - DNA, 35 bp, Artificial Sequence; identical to SEQ ID NO: 2315
  Synthetic oligonucleotide

SEQ ID NO: 2581 - DNA, 35 bp, Artificial Sequence; identical to SEQ ID NO: 2316
  Synthetic oligonucleotide

SEQ ID NO: 2582 - DNA, 38 bp, Artificial Sequence; identical to SEQ ID NO: 2317
  Synthetic oligonucleotide

SEQ ID NO: 2583 - DNA, 38 bp, Artificial Sequence; identical to SEQ ID NO: 2318
  Synthetic oligonucleotide

SEQ ID NO: 2584 - DNA, 38 bp, Artificial Sequence
  Synthetic oligonucleotide
atctatcgcctatcgctacaacccgtattcgcttctta

SEQ ID NO: 2585 - DNA, 38 bp, Artificial Sequence; identical to SEQ ID NO: 1543
  Synthetic oligonucleotide

SEQ ID NO: 2586 - DNA, 38 bp, Artificial Sequence; identical to SEQ ID NO: 1816
  Synthetic oligonucleotide

SEQ ID NO: 2587 - DNA, 38 bp, Artificial Sequence
  Synthetic oligonucleotide
attctctttattttatcgctttcatccagtgcatatga

SEQ ID NO: 2588 - DNA, 38 bp, Artificial Sequence; identical to SEQ ID NO: 1817
  Synthetic oligonucleotide

SEQ ID NO: 2589 - DNA, 35 bp, Artificial Sequence
  Synthetic oligonucleotide
ggcttcttatttgcttgaatatccgcttcctctct

SEQ ID NO: 2590 - DNA, 35 bp, Artificial Sequence; identical to SEQ ID NO: 1550
  Synthetic oligonucleotide

SEQ ID NO: 2591 - DNA, 35 bp, Artificial Sequence; identical to SEQ ID NO: 1551
  Synthetic oligonucleotide

SEQ ID NO: 2592 - DNA, 38 bp, Artificial Sequence; identical to SEQ ID NO: 1804
  Synthetic oligonucleotide

SEQ ID NO: 2593 - DNA, 37 bp, Artificial Sequence; identical to SEQ ID NO: 1820
  Synthetic oligonucleotide

SEQ ID NO: 2594 - DNA, 35 bp, Artificial Sequence; identical to SEQ ID NO: 2357
  Synthetic oligonucleotide

SEQ ID NO: 2595 - DNA, 37 bp, Artificial Sequence; identical to SEQ ID NO: 2055
  Synthetic oligonucleotide

SEQ ID NO: 2596 - DNA, 37 bp, Artificial Sequence; identical to SEQ ID NO: 2359
  Synthetic oligonucleotide

SEQ ID NO: 2597 - DNA, 36 bp, Artificial Sequence; identical to SEQ ID NO: 2360
  Synthetic oligonucleotide

SEQ ID NO: 2598 - DNA, 38 bp, Artificial Sequence; identical to SEQ ID NO: 2361
  Synthetic oligonucleotide

SEQ ID NO: 2599 - DNA, 36 bp, Artificial Sequence; identical to SEQ ID NO: 2362
  Synthetic oligonucleotide

SEQ ID NO: 2600 - DNA, 37 bp, Artificial Sequence; identical to SEQ ID NO: 2363
  Synthetic oligonucleotide

SEQ ID NO: 2601 - DNA, 38 bp, Artificial Sequence; identical to SEQ ID NO: 2364
  Synthetic oligonucleotide

SEQ ID NO: 2602 - DNA, 36 bp, Artificial Sequence; identical to SEQ ID NO: 2365
  Synthetic oligonucleotide

SEQ ID NO: 2603 - DNA, 37 bp, Artificial Sequence; identical to SEQ ID NO: 2366
  Synthetic oligonucleotide

SEQ ID NO: 2604 - DNA, 35 bp, Artificial Sequence; identical to SEQ ID NO: 2061
  Synthetic oligonucleotide

SEQ ID NO: 2605 - DNA, 38 bp, Artificial Sequence; identical to SEQ ID NO: 2024
  Synthetic oligonucleotide

SEQ ID NO: 2606 - DNA, 36 bp, Artificial Sequence; identical to SEQ ID NO: 2369
  Synthetic oligonucleotide

SEQ ID NO: 2607 - DNA, 35 bp, Artificial Sequence; identical to SEQ ID NO: 2330
  Synthetic oligonucleotide

SEQ ID NO: 2608 - DNA, 37 bp, Artificial Sequence; identical to SEQ ID NO: 2067
  Synthetic oligonucleotide

SEQ ID NO: 2609 - DNA, 35 bp, Artificial Sequence; identical to SEQ ID NO: 2372
  Synthetic oligonucleotide

SEQ ID NO: 2610 - DNA, 35 bp, Artificial Sequence; identical to SEQ ID NO: 2373
  Synthetic oligonucleotide

SEQ ID NO: 2611 - DNA, 36 bp, Artificial Sequence; identical to SEQ ID NO: 2374
  Synthetic oligonucleotide

SEQ ID NO: 2612 - DNA, 38 bp, Artificial Sequence; identical to SEQ ID NO: 2071
  Synthetic oligonucleotide

SEQ ID NO: 2613 - DNA, 35 bp, Artificial Sequence; identical to SEQ ID NO: 1597
  Synthetic oligonucleotide

SEQ ID NO: 2614 - DNA, 36 bp, Artificial Sequence; identical to SEQ ID NO: 1617
  Synthetic oligonucleotide

SEQ ID NO: 2615 - DNA, 36 bp, Artificial Sequence; identical to SEQ ID NO: 2378
  Synthetic oligonucleotide

SEQ ID NO: 2616 - DNA, 35 bp, Artificial Sequence; identical to SEQ ID NO: 1591
  Synthetic oligonucleotide

SEQ ID NO: 2617 - DNA, 36 bp, Artificial Sequence; identical to SEQ ID NO: 1590
  Synthetic oligonucleotide

SEQ ID NO: 2618 - DNA, 38 bp, Artificial Sequence; identical to SEQ ID NO: 2023
  Synthetic oligonucleotide

SEQ ID NO: 2619 - DNA, 36 bp, Artificial Sequence; identical to SEQ ID NO: 1586
  Synthetic oligonucleotide

SEQ ID NO: 2620 - DNA, 35 bp, Artificial Sequence; identical to SEQ ID NO: 1620
  Synthetic oligonucleotide

SEQ ID NO: 2621 - DNA, 35 bp, Artificial Sequence; identical to SEQ ID NO: 2384
  Synthetic oligonucleotide

SEQ ID NO: 2622 - DNA, 35 bp, Artificial Sequence; identical to SEQ ID NO: 1594
  Synthetic oligonucleotide

SEQ ID NO: 2623 - DNA, 37 bp, Artificial Sequence; identical to SEQ ID NO: 2386
  Synthetic oligonucleotide

SEQ ID NO: 2624 - DNA, 36 bp, Artificial Sequence; identical to SEQ ID NO: 2092
  Synthetic oligonucleotide

SEQ ID NO: 2625 - DNA, 35 bp, Artificial Sequence; identical to SEQ ID NO: 2388
  Synthetic oligonucleotide

SEQ ID NO: 2626 - DNA, 35 bp, Artificial Sequence; identical to SEQ ID NO: 2389
  Synthetic oligonucleotide

SEQ ID NO: 2627 - DNA, 36 bp, Artificial Sequence; identical to SEQ ID NO: 2390
  Synthetic oligonucleotide

SEQ ID NO: 2628 - DNA, 35 bp, Artificial Sequence; identical to SEQ ID NO: 1740
  Synthetic oligonucleotide

SEQ ID NO: 2629 - DNA, 37 bp, Artificial Sequence; identical to SEQ ID NO: 2094
  Synthetic oligonucleotide

SEQ ID NO: 2630 - DNA, 36 bp, Artificial Sequence; identical to SEQ ID NO: 2098
  Synthetic oligonucleotide

SEQ ID NO: 2631 - DNA, 37 bp, Artificial Sequence; identical to SEQ ID NO: 1587
  Synthetic oligonucleotide

SEQ ID NO: 2632 - DNA, 38 bp, Artificial Sequence; identical to SEQ ID NO: 2100
  Synthetic oligonucleotide

SEQ ID NO: 2633 - DNA, 35 bp, Artificial Sequence; identical to SEQ ID NO: 2396
  Synthetic oligonucleotide

SEQ ID NO: 2634 - DNA, 38 bp, Artificial Sequence; identical to SEQ ID NO: 2397
  Synthetic oligonucleotide

SEQ ID NO: 2635 - DNA, 38 bp, Artificial Sequence; identical to SEQ ID NO: 2398
  Synthetic oligonucleotide

SEQ ID NO: 2636 - DNA, 37 bp, Artificial Sequence; identical to SEQ ID NO: 2399
  Synthetic oligonucleotide

SEQ ID NO: 2637 - DNA, 37 bp, Artificial Sequence; identical to SEQ ID NO: 2400
  Synthetic oligonucleotide

SEQ ID NO: 2638 - DNA, 37 bp, Artificial Sequence; identical to SEQ ID NO: 2401
  Synthetic oligonucleotide

SEQ ID NO: 2639 - DNA, 38 bp, Artificial Sequence; identical to SEQ ID NO: 1596
  Synthetic oligonucleotide

SEQ ID NO: 2640 - DNA, 35 bp, Artificial Sequence; identical to SEQ ID NO: 2403
  Synthetic oligonucleotide

SEQ ID NO: 2641 - DNA, 35 bp, Artificial Sequence; identical to SEQ ID NO: 2114
  Synthetic oligonucleotide

SEQ ID NO: 2642 - DNA, 37 bp, Artificial Sequence; identical to SEQ ID NO: 2405
  Synthetic oligonucleotide

SEQ ID NO: 2643 - DNA, 35 bp, Artificial Sequence; identical to SEQ ID NO: 2120
  Synthetic oligonucleotide

SEQ ID NO: 2644 - DNA, 37 bp, Artificial Sequence; identical to SEQ ID NO: 2407
  Synthetic oligonucleotide

SEQ ID NO: 2645 - DNA, 37 bp, Artificial Sequence; identical to SEQ ID NO: 2408
  Synthetic oligonucleotide

SEQ ID NO: 2646 - DNA, 37 bp, Artificial Sequence; identical to SEQ ID NO: 2409
  Synthetic oligonucleotide

SEQ ID NO: 2647 - DNA, 35 bp, Artificial Sequence; identical to SEQ ID NO: 2410
  Synthetic oligonucleotide

SEQ ID NO: 2648 - DNA, 37 bp, Artificial Sequence; identical to SEQ ID NO: 1595
  Synthetic oligonucleotide

SEQ ID NO: 2649 - DNA, 35 bp, Artificial Sequence; identical to SEQ ID NO: 2412
  Synthetic oligonucleotide

SEQ ID NO: 2650 - DNA, 35 bp, Artificial Sequence; identical to SEQ ID NO: 2413
  Synthetic oligonucleotide

SEQ ID NO: 2651 - DNA, 37 bp, Artificial Sequence; identical to SEQ ID NO: 2414
  Synthetic oligonucleotide

SEQ ID NO: 2652 - DNA, 35 bp, Artificial Sequence; identical to SEQ ID NO: 2140
  Synthetic oligonucleotide

SEQ ID NO: 2653 - DNA, 35 bp, Artificial Sequence; identical to SEQ ID NO: 2014
  Synthetic oligonucleotide

SEQ ID NO: 2654 - DNA, 35 bp, Artificial Sequence; identical to SEQ ID NO: 1600
  Synthetic oligonucleotide

SEQ ID NO: 2655 - DNA, 36 bp, Artificial Sequence; identical to SEQ ID NO: 2143
  Synthetic oligonucleotide

SEQ ID NO: 2656 - DNA, 36 bp, Artificial Sequence; identical to SEQ ID NO: 2147
  Synthetic oligonucleotide

SEQ ID NO: 2657 - DNA, 36 bp, Artificial Sequence; identical to SEQ ID NO: 2151
  Synthetic oligonucleotide

SEQ ID NO: 2658 - DNA, 37 bp, Artificial Sequence; identical to SEQ ID NO: 2421
  Synthetic oligonucleotide

SEQ ID NO: 2659 - DNA, 36 bp, Artificial Sequence; identical to SEQ ID NO: 2422
  Synthetic oligonucleotide

SEQ ID NO: 2660 - DNA, 38 bp, Artificial Sequence; identical to SEQ ID NO: 2423
  Synthetic oligonucleotide

SEQ ID NO: 2661 - DNA, 38 bp, Artificial Sequence; identical to SEQ ID NO: 2424
  Synthetic oligonucleotide

SEQ ID NO: 2662 - DNA, 35 bp, Artificial Sequence; identical to SEQ ID NO: 2425
  Synthetic oligonucleotide

SEQ ID NO: 2663 - DNA, 38 bp, Artificial Sequence; identical to SEQ ID NO: 2426
  Synthetic oligonucleotide

SEQ ID NO: 2664 - DNA, 38 bp, Artificial Sequence; identical to SEQ ID NO: 1601
  Synthetic oligonucleotide

SEQ ID NO: 2665 - DNA, 36 bp, Artificial Sequence; identical to SEQ ID NO: 2428
  Synthetic oligonucleotide

SEQ ID NO: 2666 - DNA, 35 bp, Artificial Sequence; identical to SEQ ID NO: 1606
  Synthetic oligonucleotide

SEQ ID NO: 2667 - DNA, 37 bp, Artificial Sequence; identical to SEQ ID NO: 2166
  Synthetic oligonucleotide

SEQ ID NO: 2668 - DNA, 36 bp, Artificial Sequence; identical to SEQ ID NO: 1598
  Synthetic oligonucleotide

SEQ ID NO: 2669 - DNA, 38 bp, Artificial Sequence; identical to SEQ ID NO: 1772
  Synthetic oligonucleotide

SEQ ID NO: 2670 - DNA, 35 bp, Artificial Sequence; identical to SEQ ID NO: 2433
  Synthetic oligonucleotide

SEQ ID NO: 2671 - DNA, 36 bp, Artificial Sequence; identical to SEQ ID NO: 1602
  Synthetic oligonucleotide

SEQ ID NO: 2672 - DNA, 36 bp, Artificial Sequence; identical to SEQ ID NO: 1603
  Synthetic oligonucleotide

SEQ ID NO: 2673 - DNA, 35 bp, Artificial Sequence; identical to SEQ ID NO: 2436
  Synthetic oligonucleotide

SEQ ID NO: 2674 - DNA, 37 bp, Artificial Sequence; identical to SEQ ID NO: 2178
  Synthetic oligonucleotide

SEQ ID NO: 2675 - DNA, 36 bp, Artificial Sequence; identical to SEQ ID NO: 2048
  Synthetic oligonucleotide

SEQ ID NO: 2676 - DNA, 35 bp, Artificial Sequence; identical to SEQ ID NO: 1607
  Synthetic oligonucleotide

SEQ ID NO: 2677 - DNA, 36 bp, Artificial Sequence; identical to SEQ ID NO: 2440
  Synthetic oligonucleotide

SEQ ID NO: 2678 - DNA, 35 bp, Artificial Sequence; identical to SEQ ID NO: 2441
  Synthetic oligonucleotide

SEQ ID NO: 2679 - DNA, 35 bp, Artificial Sequence; identical to SEQ ID NO: 2442
  Synthetic oligonucleotide

SEQ ID NO: 2680 - DNA, 35 bp, Artificial Sequence; identical to SEQ ID NO: 2186
  Synthetic oligonucleotide

SEQ ID NO: 2681 - DNA, 38 bp, Artificial Sequence; identical to SEQ ID NO: 2444
  Synthetic oligonucleotide

SEQ ID NO: 2682 - DNA, 35 bp, Artificial Sequence; identical to SEQ ID NO: 2445
  Synthetic oligonucleotide

SEQ ID NO: 2683 - DNA, 38 bp, Artificial Sequence; identical to SEQ ID NO: 2446
  Synthetic oligonucleotide

SEQ ID NO: 2684 - DNA, 36 bp, Artificial Sequence; identical to SEQ ID NO: 1638
  Synthetic oligonucleotide

SEQ ID NO: 2685 - DNA, 36 bp, Artificial Sequence; identical to SEQ ID NO: 2038
  Synthetic oligonucleotide

SEQ ID NO: 2686 - DNA, 38 bp, Artificial Sequence; identical to SEQ ID NO: 1608
  Synthetic oligonucleotide

SEQ ID NO: 2687 - DNA, 35 bp, Artificial Sequence; identical to SEQ ID NO: 2450
  Synthetic oligonucleotide

SEQ ID NO: 2688 - DNA, 37 bp, Artificial Sequence; identical to SEQ ID NO: 1639
  Synthetic oligonucleotide

SEQ ID NO: 2689 - DNA, 38 bp, Artificial Sequence; identical to SEQ ID NO: 2452
  Synthetic oligonucleotide

SEQ ID NO: 2690 - DNA, 38 bp, Artificial Sequence; identical to SEQ ID NO: 2453
  Synthetic oligonucleotide

SEQ ID NO: 2691 - DNA, 38 bp, Artificial Sequence; identical to SEQ ID NO: 2454
  Synthetic oligonucleotide

SEQ ID NO: 2692 - DNA, 36 bp, Artificial Sequence; identical to SEQ ID NO: 2455
  Synthetic oligonucleotide

SEQ ID NO: 2693 - DNA, 36 bp, Artificial Sequence; identical to SEQ ID NO: 2456
  Synthetic oligonucleotide

SEQ ID NO: 2694 - DNA, 36 bp, Artificial Sequence; identical to SEQ ID NO: 1604
  Synthetic oligonucleotide

SEQ ID NO: 2695 - DNA, 36 bp, Artificial Sequence; identical to SEQ ID NO: 2458
  Synthetic oligonucleotide

SEQ ID NO: 2696 - DNA, 37 bp, Artificial Sequence; identical to SEQ ID NO: 2459
  Synthetic oligonucleotide

SEQ ID NO: 2697 - DNA, 35 bp, Artificial Sequence; identical to SEQ ID NO: 2460
  Synthetic oligonucleotide

SEQ ID NO: 2698 - DNA, 36 bp, Artificial Sequence; identical to SEQ ID NO: 2461
  Synthetic oligonucleotide

SEQ ID NO: 2699 - DNA, 35 bp, Artificial Sequence; identical to SEQ ID NO: 2462
  Synthetic oligonucleotide

SEQ ID NO: 2700 - DNA, 37 bp, Artificial Sequence; identical to SEQ ID NO: 2463
  Synthetic oligonucleotide

SEQ ID NO: 2701 - DNA, 36 bp, Artificial Sequence; identical to SEQ ID NO: 1750
  Synthetic oligonucleotide

SEQ ID NO: 2702 - DNA, 36 bp, Artificial Sequence; identical to SEQ ID NO: 2465
  Synthetic oligonucleotide

SEQ ID NO: 2703 - DNA, 35 bp, Artificial Sequence; identical to SEQ ID NO: 2466
  Synthetic oligonucleotide

SEQ ID NO: 2704 - DNA, 37 bp, Artificial Sequence; identical to SEQ ID NO: 2209
  Synthetic oligonucleotide

SEQ ID NO: 2705 - DNA, 36 bp, Artificial Sequence; identical to SEQ ID NO: 2468
  Synthetic oligonucleotide

SEQ ID NO: 2706 - DNA, 38 bp, Artificial Sequence; identical to SEQ ID NO: 1609
  Synthetic oligonucleotide

SEQ ID NO: 2707 - DNA, 38 bp, Artificial Sequence; identical to SEQ ID NO: 2470
  Synthetic oligonucleotide

SEQ ID NO: 2708 - DNA, 38 bp, Artificial Sequence; identical to SEQ ID NO: 2218
  Synthetic oligonucleotide

SEQ ID NO: 2709 - DNA, 35 bp, Artificial Sequence; identical to SEQ ID NO: 2472
  Synthetic oligonucleotide

SEQ ID NO: 2710 - DNA, 37 bp, Artificial Sequence; identical to SEQ ID NO: 2473
  Synthetic oligonucleotide

SEQ ID NO: 2711 - DNA, 36 bp, Artificial Sequence; identical to SEQ ID NO: 2474
  Synthetic oligonucleotide

SEQ ID NO: 2712 - DNA, 35 bp, Artificial Sequence; identical to SEQ ID NO: 1644
  Synthetic oligonucleotide

SEQ ID NO: 2713 - DNA, 36 bp, Artificial Sequence; identical to SEQ ID NO: 2476
  Synthetic oligonucleotide

SEQ ID NO: 2714 - DNA, 35 bp, Artificial Sequence; identical to SEQ ID NO: 2477
  Synthetic oligonucleotide

SEQ ID NO: 2715 - DNA, 38 bp, Artificial Sequence; identical to SEQ ID NO: 2341
  Synthetic oligonucleotide

SEQ ID NO: 2716 - DNA, 36 bp, Artificial Sequence; identical to SEQ ID NO: 2479
  Synthetic oligonucleotide

SEQ ID NO: 2717 - DNA, 38 bp, Artificial Sequence; identical to SEQ ID NO: 2480
  Synthetic oligonucleotide

SEQ ID NO: 2718 - DNA, 37 bp, Artificial Sequence; identical to SEQ ID NO: 2481
  Synthetic oligonucleotide

SEQ ID NO: 2719 - DNA, 36 bp, Artificial Sequence; identical to SEQ ID NO: 2482
  Synthetic oligonucleotide

SEQ ID NO: 2720 - DNA, 36 bp, Artificial Sequence; identical to SEQ ID NO: 2483
  Synthetic oligonucleotide

SEQ ID NO: 2721 - DNA, 35 bp, Artificial Sequence; identical to SEQ ID NO: 2484
  Synthetic oligonucleotide

SEQ ID NO: 2722 - DNA, 38 bp, Artificial Sequence; identical to SEQ ID NO: 2485
  Synthetic oligonucleotide

SEQ ID NO: 2723 - DNA, 36 bp, Artificial Sequence; identical to SEQ ID NO: 1611
  Synthetic oligonucleotide

SEQ ID NO: 2724 - DNA, 35 bp, Artificial Sequence; identical to SEQ ID NO: 2487
  Synthetic oligonucleotide

SEQ ID NO: 2725 - DNA, 35 bp, Artificial Sequence; identical to SEQ ID NO: 1605
  Synthetic oligonucleotide

SEQ ID NO: 2726 - DNA, 36 bp, Artificial Sequence; identical to SEQ ID NO: 2489
  Synthetic oligonucleotide

SEQ ID NO: 2727 - DNA, 37 bp, Artificial Sequence; identical to SEQ ID NO: 1649
  Synthetic oligonucleotide

SEQ ID NO: 2728 - DNA, 35 bp, Artificial Sequence; identical to SEQ ID NO: 1599
  Synthetic oligonucleotide

SEQ ID NO: 2729 - DNA, 36 bp, Artificial Sequence
  Synthetic oligonucleotide
aattgtgaatcacaactcctggtatataggctttga

SEQ ID NO: 2730 - DNA, 36 bp, Artificial Sequence
  Synthetic oligonucleotide
cggcatacgaacctgtctcaaatcctagtaaggtaa

SEQ ID NO: 2731 - DNA, 36 bp, Artificial Sequence
  Synthetic oligonucleotide
agttgtgaaacacaactcctggtatataggctttga

SEQ ID NO: 2732 - DNA, 36 bp, Artificial Sequence
  Synthetic oligonucleotide
gagcttgatatcatcttccacttcttcgctattcta

SEQ ID NO: 2733 - DNA, 38 bp, Artificial Sequence
  Synthetic oligonucleotide
ggtcataatgtgaatcatgaatagtactaatttactga

SEQ ID NO: 2734 - DNA, 36 bp, Artificial Sequence
  Synthetic oligonucleotide
tggcggctcacgtattctgaaagttagtggtgcgga

SEQ ID NO: 2735 - DNA, 37 bp, Artificial Sequence
  Synthetic oligonucleotide
tagctcatgggttgcatcctcaggataactccgctga

SEQ ID NO: 2736 - DNA, 35 bp, Artificial Sequence
  Synthetic oligonucleotide
tcttattttcgcaagatcttttatctaaatacaat

SEQ ID NO: 2737 - DNA, 38 bp, Artificial Sequence
  Synthetic oligonucleotide
tttcgaccattgtgggatttccggcggtccaattatga

SEQ ID NO: 2738 - DNA, 38 bp, Artificial Sequence
  Synthetic oligonucleotide
actaggaagaacaggtacgtagggacacctgacagtga

SEQ ID NO: 2739 - DNA, 37 bp, Artificial Sequence
  Synthetic oligonucleotide
gacagctatcaacgaccgacaacggaaattggtgtga

SEQ ID NO: 2740 - DNA, 37 bp, Artificial Sequence
  Synthetic oligonucleotide
gggcgtcccttgcgttctctcaacgaatgtgtcgcga

SEQ ID NO: 2741 - DNA, 38 bp, Artificial Sequence
  Synthetic oligonucleotide
tggcgggcgtgggtgttgccgagacgtcagtaccgtga

SEQ ID NO: 2742 - DNA, 37 bp, Artificial Sequence
  Synthetic oligonucleotide
tggagcggcgagttggaatcctgatgtgggctcatga

SEQ ID NO: 2743 - DNA, 38 bp, Artificial Sequence
  Synthetic oligonucleotide
atagataaatggggaggtcgcgcattgaatgatggtga

SEQ ID NO: 2744 - DNA, 38 bp, Artificial Sequence
  Synthetic oligonucleotide
gccgtatgattaagcgatctctggcatatggcatctga

SEQ ID NO: 2745 - DNA, 38 bp, Artificial Sequence
  Synthetic oligonucleotide
tctcgaagttccgtttagccccaaggtcgcgggcgtga

SEQ ID NO: 2746 - DNA, 37 bp, Artificial Sequence
  Synthetic oligonucleotide
aaccgggtgtccaaaccgtaatttaatgtttctggga

SEQ ID NO: 2747 - DNA, 37 bp, Artificial Sequence
  Synthetic oligonucleotide
aaccgggcgtccaaaccgtaatttaatgtttctggga

SEQ ID NO: 2748 - DNA, 35 bp, Artificial Sequence
  Synthetic oligonucleotide
ataattcgcgtccggtccttggaaataaacggcgt

SEQ ID NO: 2749 - DNA, 35 bp, Artificial Sequence
  Synthetic oligonucleotide
gggcggcctcgttttatcgggaaaaggaacaaagt

SEQ ID NO: 2750 - DNA, 35 bp, Artificial Sequence
  Synthetic oligonucleotide
gggcggcctcgttttatcgggaaaaggaacaatat

SEQ ID NO: 2751 - DNA, 35 bp, Artificial Sequence
  Synthetic oligonucleotide
gggcggcctcgttttatcgggaaaaggaacaatct

SEQ ID NO: 2752 - DNA, 36 bp, Artificial Sequence
  Synthetic oligonucleotide
tggctgctggacgcgtcttacagccgaccacatcaa

SEQ ID NO: 2753 - DNA, 38 bp, Artificial Sequence
  Synthetic oligonucleotide
tagccctaattgcgcttcttagcagggctcgtggttga

SEQ ID NO: 2754 - DNA, 35 bp, Artificial Sequence
  Synthetic oligonucleotide
tttaggctttagggtacgacagcaataggtacaaa

SEQ ID NO: 2755 - DNA, 38 bp, Artificial Sequence
  Synthetic oligonucleotide
atagataaatggggagagcgcgcattgaatgatggtga

SEQ ID NO: 2756 - DNA, 35 bp, Artificial Sequence
  Synthetic oligonucleotide
gagagaagtatttgttaagccacatagttttcata

SEQ ID NO: 2757 - DNA, 35 bp, Artificial Sequence
  Synthetic oligonucleotide
gagagaagtatttgttaagccacatagttttcatc

SEQ ID NO: 2758 - DNA, 36 bp, Artificial Sequence; identical to SEQ ID NO: 2732
  Synthetic oligonucleotide

SEQ ID NO: 2759 - DNA, 35 bp, Artificial Sequence
  Synthetic oligonucleotide
tcttattttagcaagatcttttatctaaataaact

SEQ ID NO: 2760 - DNA, 35 bp, Artificial Sequence
  Synthetic oligonucleotide
tcttattttagcaagatcttttatctaaatacctt

SEQ ID NO: 2761 - DNA, 35 bp, Artificial Sequence
  Synthetic oligonucleotide
tcttattttagcaagatcttttatctaaatactaa

SEQ ID NO: 2762 - DNA, 35 bp, Artificial Sequence
  Synthetic oligonucleotide
tcttattttagcaagatcttttatctaaatactag

SEQ ID NO: 2763 - DNA, 37 bp, Artificial Sequence
  Synthetic oligonucleotide
tgggaggttcagaagtctttggccttgatctgcagga

SEQ ID NO: 2764 - DNA, 36 bp, Artificial Sequence
  Synthetic oligonucleotide
accaccaaatccccaaccacttttccgcttatccca

SEQ ID NO: 2765 - DNA, 35 bp, Artificial Sequence
  Synthetic oligonucleotide
catgcagccccacaccgcttttatattgttttctc

SEQ ID NO: 2766 - DNA, 35 bp, Artificial Sequence
  Synthetic oligonucleotide
catgcataggctcactcctggaacactacctttat

SEQ ID NO: 2767 - DNA, 36 bp, Artificial Sequence
  Synthetic oligonucleotide
caacagtcatgtcaccctattatttgctttcattca

SEQ ID NO: 2768 - DNA, 36 bp, Artificial Sequence
  Synthetic oligonucleotide
catgccatatgtcccatcacttacctaccatcccta

SEQ ID NO: 2769 - DNA, 35 bp, Artificial Sequence
  Synthetic oligonucleotide
catgcgatccaatcctatagtccttggaccttata

SEQ ID NO: 2770 - DNA, 35 bp, Artificial Sequence
  Synthetic oligonucleotide
catgcgatccctcacacaactttcatcccaatacc

SEQ ID NO: 2771 - DNA, 35 bp, Artificial Sequence
  Synthetic oligonucleotide
cttgcgatattaactttccatcactttccttcttt

SEQ ID NO: 2772 - DNA, 35 bp, Artificial Sequence
  Synthetic oligonucleotide
catgcgccgatacccatttcccaattcctcttcaa

SEQ ID NO: 2773 - DNA, 35 bp, Artificial Sequence
  Synthetic oligonucleotide
cactgccacgtcaaatgcctctttcatttccattt

SEQ ID NO: 2774 - DNA, 36 bp, Artificial Sequence
  Synthetic oligonucleotide
cactgcggtcgagcctcctaattgttctcaccctta

SEQ ID NO: 2775 - DNA, 38 bp, Artificial Sequence
  Synthetic oligonucleotide
cgaacagtggtacacgacgtagtgcactctttttatga

SEQ ID NO: 2776 - DNA, 35 bp, Artificial Sequence
  Synthetic oligonucleotide
attgatctgcatgtgccattttcccacctttgttt

SEQ ID NO: 2777 - DNA, 35 bp, Artificial Sequence
  Synthetic oligonucleotide
gcacatgcgtactctcattaacttcattaccatcc

SEQ ID NO: 2778 - DNA, 35 bp, Artificial Sequence
  Synthetic oligonucleotide
gcgattacccactcttgtaaactaatttgcccatt

SEQ ID NO: 2779 - DNA, 38 bp, Artificial Sequence
  Synthetic oligonucleotide
gagacacgccactctcacgacacgttccttatttctga

SEQ ID NO: 2780 - DNA, 35 bp, Artificial Sequence; identical to SEQ ID NO: 452
  Synthetic oligonucleotide

SEQ ID NO: 2781 - DNA, 34 bp, Artificial Sequence
  Synthetic oligonucleotide
gccacaacacaattcttccgccatcactgcccaa

SEQ ID NO: 2782 - DNA, 35 bp, Artificial Sequence
  Synthetic oligonucleotide
gcctgaccacccgtataatttaccgcctaaacctt

SEQ ID NO: 2783 - DNA, 34 bp, Artificial Sequence; identical to SEQ ID NO: 161
  Synthetic oligonucleotide

SEQ ID NO: 2784 - DNA, 36 bp, Artificial Sequence
  Synthetic oligonucleotide
tacgactcatacttccattccgcctaaccttttcca

SEQ ID NO: 2785 - DNA, 35 bp, Artificial Sequence
  Synthetic oligonucleotide
gcgtatcaccatggctcacttttcctatctccttt

SEQ ID NO: 2786 - DNA, 35 bp, Artificial Sequence
  Synthetic oligonucleotide
ggccacgtaacagctactcaacgcgcaacactaac

SEQ ID NO: 2787 - DNA, 36 bp, Artificial Sequence
  Synthetic oligonucleotide
gcggccacactttgccttcttattcgttaattccta

SEQ ID NO: 2788 - DNA, 35 bp, Artificial Sequence
  Synthetic oligonucleotide
tgctgtcaacgcgaagatctttctcttttattctt

SEQ ID NO: 2789 - DNA, 35 bp, Artificial Sequence
  Synthetic oligonucleotide
tatgcggcgaacgccttctatttcctggttctctt

SEQ ID NO: 2790 - DNA, 35 bp, Artificial Sequence
  Synthetic oligonucleotide
tatgccccacgataatttcctctttttgcatattt

SEQ ID NO: 2791 - DNA, 36 bp, Artificial Sequence; identical to SEQ ID NO: 570
  Synthetic oligonucleotide

SEQ ID NO: 2792 - DNA, 36 bp, Artificial Sequence
  Synthetic oligonucleotide
acaccacgcctctgccggtggacgtactgcccatta

SEQ ID NO: 2793 - DNA, 38 bp, Artificial Sequence
  Synthetic oligonucleotide
gccacgtagaacacccatcctgatccatacaatactga

SEQ ID NO: 2794 - DNA, 35 bp, Artificial Sequence; identical to SEQ ID NO: 778
  Synthetic oligonucleotide

SEQ ID NO: 2795 - DNA, 36 bp, Artificial Sequence
  Synthetic oligonucleotide
acgcacgtgcagtcgtatcccgtttcttgcgcttta

SEQ ID NO: 2796 - DNA, 35 bp, Artificial Sequence
  Synthetic oligonucleotide
gacctagaagagggcgcttaaaattgggagtggtt

SEQ ID NO: 2797 - DNA, 35 bp, Artificial Sequence
  Synthetic oligonucleotide
atgcactacgcagatgcaaactatctttcgccttc

SEQ ID NO: 2798 - DNA, 35 bp, Artificial Sequence; identical to SEQ ID NO: 429
  Synthetic oligonucleotide

SEQ ID NO: 2799 - DNA, 38 bp, Artificial Sequence
  Synthetic oligonucleotide
gatgtagctgccacgagtgcgtatactcctttatctga

SEQ ID NO: 2800 - DNA, 36 bp, Artificial Sequence
  Synthetic oligonucleotide
gcccagctgcggtcacttgcccagccattccaccaa

SEQ ID NO: 2801 - DNA, 35 bp, Artificial Sequence; identical to SEQ ID NO: 452
  Synthetic oligonucleotide

SEQ ID NO: 2802 - DNA, 34 bp, Artificial Sequence; identical to SEQ ID NO: 161
  Synthetic oligonucleotide

SEQ ID NO: 2803 - DNA, 35 bp, Artificial Sequence
  Synthetic oligonucleotide
gccgagtcaatcaagctcggattacagtgtttacc

SEQ ID NO: 2804 - DNA, 35 bp, Artificial Sequence
  Synthetic oligonucleotide
tactgcaggtacagagtatcttcatccacctccat

SEQ ID NO: 2805 - DNA, 36 bp, Artificial Sequence
  Synthetic oligonucleotide
ggtgccgttgaggtatacggaccgtgcaggccatca

SEQ ID NO: 2806 - DNA, 36 bp, Artificial Sequence; identical to SEQ ID NO: 706
  Synthetic oligonucleotide

SEQ ID NO: 2807 - DNA, 35 bp, Artificial Sequence
  Synthetic oligonucleotide
gtcgtgcgaggtcaagtactcctattctctctaaa

SEQ ID NO: 2808 - DNA, 38 bp, Artificial Sequence
  Synthetic oligonucleotide
tggagggccgagtggtgggggtttgagaagcattatga

SEQ ID NO: 2809 - DNA, 37 bp, Artificial Sequence
  Synthetic oligonucleotide
tcacgacgtacaaaggttggcgtacttaccttactga

SEQ ID NO: 2810 - DNA, 35 bp, Artificial Sequence
  Synthetic oligonucleotide
tgcactgtaggtcatttcgtttacttgccaccatc

SEQ ID NO: 2811 - DNA, 36 bp, Artificial Sequence
  Synthetic oligonucleotide
tgtaacagcagtcgcggggaattattggctcttgaa

SEQ ID NO: 2812 - DNA, 36 bp, Artificial Sequence
  Synthetic oligonucleotide
tgtacaagtcagacgcgcccaaccctgtttacacta

SEQ ID NO: 2813 - DNA, 38 bp, Artificial Sequence
  Synthetic oligonucleotide
tgtacacctgcaatgcgtggtattactttgttccttga

SEQ ID NO: 2814 - DNA, 38 bp, Artificial Sequence
  Synthetic oligonucleotide
tccacatgccgttgaactctttattccctttaccttga

SEQ ID NO: 2815 - DNA, 35 bp, Artificial Sequence
  Synthetic oligonucleotide
ttggtacccgatagaatctagtttttgtagccaag

SEQ ID NO: 2816 - DNA, 35 bp, Artificial Sequence
  Synthetic oligonucleotide
acggacatgcgagcaacaatgaacgtctttttttc

SEQ ID NO: 2817 - DNA, 36 bp, Artificial Sequence
  Synthetic oligonucleotide
aaccacgaaggtacggacacactttacataccctta

SEQ ID NO: 2818 - DNA, 38 bp, Artificial Sequence
  Synthetic oligonucleotide
atgtacgcggtacccatcacacactatgtgtcccttga

SEQ ID NO: 2819 - DNA, 35 bp, Artificial Sequence
  Synthetic oligonucleotide
agtcacacaagcctccgattcattcttctaaacat

SEQ ID NO: 2820 - DNA, 38 bp, Artificial Sequence
  Synthetic oligonucleotide
catgcgcaggtatcttgctacactattctcccgtttga

SEQ ID NO: 2821 - DNA, 36 bp, Artificial Sequence
  Synthetic oligonucleotide
atgcgcacccgctatctacccgtgacacacgcctta

SEQ ID NO: 2822 - DNA, 35 bp, Artificial Sequence
  Synthetic oligonucleotide
atctcgaaccaccaccttccatcccttatgttgtc

SEQ ID NO: 2823 - DNA, 35 bp, Artificial Sequence
  Synthetic oligonucleotide
gcgaaccggaacttaatatccttgtaaccgctatc

SEQ ID NO: 2824 - DNA, 36 bp, Artificial Sequence
  Synthetic oligonucleotide
gcaacccgacctcgctccaaccgcttacgactccta

SEQ ID NO: 2825 - DNA, 36 bp, Artificial Sequence
  Synthetic oligonucleotide
gcaccccacatcccacgatcccatggatacccgcca

SEQ ID NO: 2826 - DNA, 36 bp, Artificial Sequence
  Synthetic oligonucleotide
gccaacctcaccaccggtacgccttatcgctaatta

SEQ ID NO: 2827 - DNA, 35 bp, Artificial Sequence
  Synthetic oligonucleotide
tcagtaccgccattcccaaaaatttttccccaaca

SEQ ID NO: 2828 - DNA, 35 bp, Artificial Sequence
  Synthetic oligonucleotide
tgaagccagctgacgtacatccacatattccctac

SEQ ID NO: 2829 - DNA, 36 bp, Artificial Sequence
  Synthetic oligonucleotide
tcaaccaactcaccctcatttactcgcataacatta

SEQ ID NO: 2830 - DNA, 35 bp, Artificial Sequence
  Synthetic oligonucleotide
tatgcccgcctgactctcttattactggttccgac

SEQ ID NO: 2831 - DNA, 36 bp, Artificial Sequence
  Synthetic oligonucleotide
actgctggcaccgcaatctacctaaagtttccgtta

SEQ ID NO: 2832 - DNA, 35 bp, Artificial Sequence
  Synthetic oligonucleotide
accacgcactcaggttcatgcatcttgaactttac

SEQ ID NO: 2833 - DNA, 36 bp, Artificial Sequence
  Synthetic oligonucleotide
gaccgtcgcaggccgtggctagcaggacgttggcta

SEQ ID NO: 2834 - DNA, 38 bp, Artificial Sequence
  Synthetic oligonucleotide
gacgaacgtgctgttggtattttttgaactcttattga

SEQ ID NO: 2835 - DNA, 37 bp, Artificial Sequence
  Synthetic oligonucleotide
gacatcctggaggtcctaactgcggtctcacacttga

SEQ ID NO: 2836 - DNA, 35 bp, Artificial Sequence
  Synthetic oligonucleotide
atgccggggtcacgacgttaccgcactccatctat

SEQ ID NO: 2837 - DNA, 35 bp, Artificial Sequence
  Synthetic oligonucleotide
atcagcaacgcccagtggtgcaagctttacccttt

SEQ ID NO: 2838 - DNA, 36 bp, Artificial Sequence
  Synthetic oligonucleotide
gactaccgtacgtgcatggcccccagttacacaata

SEQ ID NO: 2839 - DNA, 35 bp, Artificial Sequence
  Synthetic oligonucleotide
tacctcaaccgcgaactttgctacgttttgtaggg

SEQ ID NO: 2840 - DNA, 35 bp, Artificial Sequence
  Synthetic oligonucleotide
tacgctgtcgtgtgaggccctaccgctcccctatc

SEQ ID NO: 2841 - DNA, 35 bp, Artificial Sequence
  Synthetic oligonucleotide
gtcacggaagcagttacgaacgatgcccttccatc

SEQ ID NO: 2842 - DNA, 36 bp, Artificial Sequence; identical to SEQ ID NO: 2811
  Synthetic oligonucleotide

SEQ ID NO: 2843 - DNA, 35 bp, Artificial Sequence
  Synthetic oligonucleotide
ttgtgacgtctcgtgcgcattaccggttaatattt

SEQ ID NO: 2844 - DNA, 35 bp, Artificial Sequence; identical to SEQ ID NO: 2815
  Synthetic oligonucleotide

SEQ ID NO: 2845 - DNA, 35 bp, Artificial Sequence
  Synthetic oligonucleotide
tttaacgtagtgagtcaccattgatcctttaattt

SEQ ID NO: 2846 - DNA, 35 bp, Artificial Sequence
  Synthetic oligonucleotide
acccacgcctaccctaatccttgtctgttattttc

SEQ ID NO: 2847 - DNA, 36 bp, Artificial Sequence
  Synthetic oligonucleotide
catgccgaataatctctttcgttcctggtcctttta

SEQ ID NO: 2848 - DNA, 37 bp, Artificial Sequence
  Synthetic oligonucleotide
catgccgccaaaccacactgttccgtcttacttatga

SEQ ID NO: 2849 - DNA, 35 bp, Artificial Sequence
  Synthetic oligonucleotide
catgcgaacaacctttaccattcactagcacccct

SEQ ID NO: 2850 - DNA, 38 bp, Artificial Sequence
  Synthetic oligonucleotide
catgcgacacgctctatcgctttcacatcttcgcttga

SEQ ID NO: 2851 - DNA, 35 bp, Artificial Sequence; identical to SEQ ID NO: 2770
  Synthetic oligonucleotide

SEQ ID NO: 2852 - DNA, 35 bp, Artificial Sequence
  Synthetic oligonucleotide
catgcgcactttcctcacatgataccctgcatgac

SEQ ID NO: 2853 - DNA, 35 bp, Artificial Sequence
  Synthetic oligonucleotide
catgcgcatccaatcacactttttaatttcatttc

SEQ ID NO: 2854 - DNA, 35 bp, Artificial Sequence
  Synthetic oligonucleotide
atgcctagcagccaagcaatgcctttcatttattc

SEQ ID NO: 2855 - DNA, 36 bp, Artificial Sequence
  Synthetic oligonucleotide
gccgcagccatcatctacgcttcacactcatcacca

SEQ ID NO: 2856 - DNA, 36 bp, Artificial Sequence
  Synthetic oligonucleotide
ggtacgcaggcgcgatttgtacatttttgatcctga

SEQ ID NO: 2857 - DNA, 38 bp, Artificial Sequence
  Synthetic oligonucleotide
tctaacgtactatcatgtgccacgccttcatttcctga

SEQ ID NO: 2858 - DNA, 35 bp, Artificial Sequence
  Synthetic oligonucleotide
tcaactgccaccgaccccaacccgcgacccatcct

SEQ ID NO: 2859 - DNA, 36 bp, Artificial Sequence; identical to SEQ ID NO: 368
  Synthetic oligonucleotide

SEQ ID NO: 2860 - DNA, 36 bp, Artificial Sequence
  Synthetic oligonucleotide
cgcgagccagggtactgcctgcggtctaaacaataa

SEQ ID NO: 2861 - DNA, 36 bp, Artificial Sequence; identical to SEQ ID NO: 151
  Synthetic oligonucleotide

SEQ ID NO: 2862 - DNA, 35 bp, Artificial Sequence; identical to SEQ ID NO: 326
  Synthetic oligonucleotide

SEQ ID NO: 2863 - DNA, 35 bp, Artificial Sequence; identical to SEQ ID NO: 181
  Synthetic oligonucleotide

SEQ ID NO: 2864 - DNA, 38 bp, Artificial Sequence; identical to SEQ ID NO: 852
  Synthetic oligonucleotide

SEQ ID NO: 2865 - DNA, 36 bp, Artificial Sequence; identical to SEQ ID NO: 184
  Synthetic oligonucleotide

SEQ ID NO: 2866 - DNA, 36 bp, Artificial Sequence
  Synthetic oligonucleotide
tgggtgtcgtactggtaccaaggagtgcgaaatcta

SEQ ID NO: 2867 - DNA, 35 bp, Artificial Sequence; identical to SEQ ID NO: 272
  Synthetic oligonucleotide

SEQ ID NO: 2868 - DNA, 35 bp, Artificial Sequence
  Synthetic oligonucleotide
acgcgcataaaccaatcactaccgaccacttattc

SEQ ID NO: 2869 - DNA, 35 bp, Artificial Sequence
  Synthetic oligonucleotide
acgtcaggcataaattcttcaaactcttactatca

SEQ ID NO: 2870 - DNA, 36 bp, Artificial Sequence
  Synthetic oligonucleotide
catgcccggaccattattattcgcttaccattccca

SEQ ID NO: 2871 - DNA, 37 bp, Artificial Sequence
  Synthetic oligonucleotide
catgccgaccactgttccttttacctcttatacctga

SEQ ID NO: 2872 - DNA, 35 bp, Artificial Sequence
  Synthetic oligonucleotide
catgcgaacagacgaatgattcttacaaccgcaac

SEQ ID NO: 2873 - DNA, 35 bp, Artificial Sequence
  Synthetic oligonucleotide
cccgtccgcaggcatccacgtttatgccttttatc

SEQ ID NO: 2874 - DNA, 36 bp, Artificial Sequence
  Synthetic oligonucleotide
cacgcgaccctcattaacatcatctaacccaatcca

SEQ ID NO: 2875 - DNA, 35 bp, Artificial Sequence
  Synthetic oligonucleotide
catgcgccaattttactgtacatttctttttttat

SEQ ID NO: 2876 - DNA, 35 bp, Artificial Sequence
  Synthetic oligonucleotide
catgcgcgccgacctactcgcttaatctcacgttt

SEQ ID NO: 2877 - DNA, 35 bp, Artificial Sequence
  Synthetic oligonucleotide
catggcgaccctcaatctcacattttacctcttct

SEQ ID NO: 2878 - DNA, 35 bp, Artificial Sequence
  Synthetic oligonucleotide
gacggactgcgtatcgcatagtttatccttttttt

SEQ ID NO: 2879 - DNA, 35 bp, Artificial Sequence
  Synthetic oligonucleotide
gcccaccatatcgcaatcatattcctcgccttgtt

SEQ ID NO: 2880 - DNA, 35 bp, Artificial Sequence
  Synthetic oligonucleotide
gcgcatgtcaaccttacctctattggcccttattc

SEQ ID NO: 2881 - DNA, 35 bp, Artificial Sequence
  Synthetic oligonucleotide
gcatccagtccataactcaatctcacctgtaattc

SEQ ID NO: 2882 - DNA, 35 bp, Artificial Sequence
  Synthetic oligonucleotide
gccgcatacccctgtaatttcgtaacctacaccca

SEQ ID NO: 2883 - DNA, 34 bp, Artificial Sequence
  Synthetic oligonucleotide
gcgcaactccgactatcactgccttaccaatcac

SEQ ID NO: 2884 - DNA, 36 bp, Artificial Sequence
  Synthetic oligonucleotide
gcgacgcctctgacctacatataactttgatagtaa

SEQ ID NO: 2885 - DNA, 35 bp, Artificial Sequence
  Synthetic oligonucleotide
gcgacgcgtgaacacccttattctgtaatcttttt

SEQ ID NO: 2886 - DNA, 35 bp, Artificial Sequence
  Synthetic oligonucleotide
gtactgtcaacccgatctttgtttgtatttatttt

SEQ ID NO: 2887 - DNA, 38 bp, Artificial Sequence
  Synthetic oligonucleotide
gcgcggtactcattatccttatatcatcttacatttga

SEQ ID NO: 2888 - DNA, 37 bp, Artificial Sequence
  Synthetic oligonucleotide
tatgcgagcccatttttcacctttgctatttcttaga

SEQ ID NO: 2889 - DNA, 35 bp, Artificial Sequence
  Synthetic oligonucleotide
tcctccagcacattctaccacactaccacattcat

SEQ ID NO: 2890 - DNA, 35 bp, Artificial Sequence
  Synthetic oligonucleotide
tatgcggtgccacttctctattacttctattactt

SEQ ID NO: 2891 - DNA, 36 bp, Artificial Sequence
  Synthetic oligonucleotide
tcatgcagcctagtatctatcctaccatattattca

SEQ ID NO: 2892 - DNA, 35 bp, Artificial Sequence
  Synthetic oligonucleotide
tgacggacagtgcatgcgttatacttattctctat

SEQ ID NO: 2893 - DNA, 38 bp, Artificial Sequence
  Synthetic oligonucleotide
aagcctggccgtggtgctgcagtttattccgttagtga

SEQ ID NO: 2894 - DNA, 36 bp, Artificial Sequence; identical to SEQ ID NO: 2860
  Synthetic oligonucleotide

SEQ ID NO: 2895 - DNA, 36 bp, Artificial Sequence; identical to SEQ ID NO: 151
  Synthetic oligonucleotide

SEQ ID NO: 2896 - DNA, 36 bp, Artificial Sequence
  Synthetic oligonucleotide
gcattcgcgtactgtggacaacctatatccgggtaa

SEQ ID NO: 2897 - DNA, 36 bp, Artificial Sequence
  Synthetic oligonucleotide
gcaactatcgcgagcgccttcaagattagcgtgtca

SEQ ID NO: 2898 - DNA, 38 bp, Artificial Sequence; identical to SEQ ID NO: 169
  Synthetic oligonucleotide

SEQ ID NO: 2899 - DNA, 38 bp, Artificial Sequence
  Synthetic oligonucleotide
gtgcggggccacaggtgatagcaatgcatgccctatga

SEQ ID NO: 2900 - DNA, 37 bp, Artificial Sequence
  Synthetic oligonucleotide
tcaccccaagcagtcattgcctacaggagtctggtga

SEQ ID NO: 2901 - DNA, 37 bp, Artificial Sequence
  Synthetic oligonucleotide
tgcagttagtgcaatgaatatctcggacacgcggaga

SEQ ID NO: 2902 - DNA, 35 bp, Artificial Sequence
  Synthetic oligonucleotide
tccgcagacagccgggggtcaggactacggctacg

SEQ ID NO: 2903 - DNA, 37 bp, Artificial Sequence
  Synthetic oligonucleotide
ttacagctactctgcgctccaagtggacactttacga

SEQ ID NO: 2904 - DNA, 36 bp, Artificial Sequence
  Synthetic oligonucleotide
ttagcatcactgacttggatacatacagcatgtcga

SEQ ID NO: 2905 - DNA, 35 bp, Artificial Sequence
  Synthetic oligonucleotide
agcacgactgcaatccacatccgttcttattcctt

SEQ ID NO: 2906 - DNA, 37 bp, Artificial Sequence
  Synthetic oligonucleotide
aatgcgcacatctgtttttgtaccttagaatgtttga

SEQ ID NO: 2907 - DNA, 35 bp, Artificial Sequence; identical to SEQ ID NO: 2869
  Synthetic oligonucleotide

SEQ ID NO: 2908 - DNA, 36 bp, Artificial Sequence
  Synthetic oligonucleotide
catgcaccactcgcacattccaccacaatctataca

SEQ ID NO: 2909 - DNA, 35 bp, Artificial Sequence
  Synthetic oligonucleotide
ctgccactagccgcccatactatccacaccataat

SEQ ID NO: 2910 - DNA, 35 bp, Artificial Sequence
  Synthetic oligonucleotide
ccatgcgcggtcacacataccagtccttaccattt

SEQ ID NO: 2911 - DNA, 35 bp, Artificial Sequence
  Synthetic oligonucleotide
catgccgacacaccacttttttccgaccgacttcc

SEQ ID NO: 2912 - DNA, 35 bp, Artificial Sequence
  Synthetic oligonucleotide
catgccgcctttcgacttccatatcccaacacgac

SEQ ID NO: 2913 - DNA, 35 bp, Artificial Sequence; identical to SEQ ID NO: 194
  Synthetic oligonucleotide

SEQ ID NO: 2914 - DNA, 35 bp, Artificial Sequence; identical to SEQ ID NO: 195
  Synthetic oligonucleotide

SEQ ID NO: 2915 - DNA, 35 bp, Artificial Sequence
  Synthetic oligonucleotide
cttgccgatcccgctccctagttcccttgcccact

SEQ ID NO: 2916 - DNA, 36 bp, Artificial Sequence
  Synthetic oligonucleotide
cacgcatgtctgcgctcgtatcttttcaccctatga

SEQ ID NO: 2917 - DNA, 38 bp, Artificial Sequence
  Synthetic oligonucleotide
cactgcggtcaacacccaccaacctccgaccttactga

SEQ ID NO: 2918 - DNA, 38 bp, Artificial Sequence
  Synthetic oligonucleotide
catgcgtacgccactttcgcctactctaacatatctga

SEQ ID NO: 2919 - DNA, 35 bp, Artificial Sequence
  Synthetic oligonucleotide
cagtctgcgcgaccctttctgttccttcatcccca

SEQ ID NO: 2920 - DNA, 35 bp, Artificial Sequence
  Synthetic oligonucleotide
cattgcgccttctattttattttccttatatttgt

SEQ ID NO: 2921 - DNA, 38 bp, Artificial Sequence
  Synthetic oligonucleotide
cattgcggccattacccctctaccgttaccctttttga

SEQ ID NO: 2922 - DNA, 35 bp, Artificial Sequence
  Synthetic oligonucleotide
gcacacacctgcggagcaccactccaaattaccca

SEQ ID NO: 2923 - DNA, 35 bp, Artificial Sequence
  Synthetic oligonucleotide
gcacactacgtttaccctggcccttctaattgttt

SEQ ID NO: 2924 - DNA, 35 bp, Artificial Sequence
  Synthetic oligonucleotide
gcactgccattgatttcttcccacttcacactctt

SEQ ID NO: 2925 - DNA, 36 bp, Artificial Sequence
  Synthetic oligonucleotide
gcgaacactgatcttaactaacgcccgcccaattta

SEQ ID NO: 2926 - DNA, 36 bp, Artificial Sequence
  Synthetic oligonucleotide
gcacccccaatgaccgccatcaaaccatatattcca

SEQ ID NO: 2927 - DNA, 36 bp, Artificial Sequence
  Synthetic oligonucleotide
gcgcaaccatcactataacccatttacctgttttca

SEQ ID NO: 2928 - DNA, 38 bp, Artificial Sequence
  Synthetic oligonucleotide
gcgcaccacacttgagttctttaactttccctttatga

SEQ ID NO: 2929 - DNA, 35 bp, Artificial Sequence
  Synthetic oligonucleotide
gccgacgtacctgctgggtctctctattcattttt

SEQ ID NO: 2930 - DNA, 35 bp, Artificial Sequence
  Synthetic oligonucleotide
tacgccgtccaccatcctcttctatatacctaacc

SEQ ID NO: 2931 - DNA, 35 bp, Artificial Sequence
  Synthetic oligonucleotide
tactacgaaccatcccactctttgcacctgttttc

SEQ ID NO: 2932 - DNA, 34 bp, Artificial Sequence
  Synthetic oligonucleotide
tcatgcgcggtacacatttcttaatcacttttct

SEQ ID NO: 2933 - DNA, 35 bp, Artificial Sequence
  Synthetic oligonucleotide
tgcgggcattggtgcaatcttaacttattctttat

SEQ ID NO: 2934 - DNA, 35 bp, Artificial Sequence
  Synthetic oligonucleotide
tggtagtgctgcatcaccgatcatccttttacatt

SEQ ID NO: 2935 - DNA, 37 bp, Artificial Sequence
  Synthetic oligonucleotide
tccgcgactgttcatcccccatcccaacataacccga

SEQ ID NO: 2936 - DNA, 38 bp, Artificial Sequence
  Synthetic oligonucleotide
tgtgaacgtcactgcaccctaaactaatattcccttga

SEQ ID NO: 2937 - DNA, 36 bp, Artificial Sequence
  Synthetic oligonucleotide
ttgacaactgccactaccaactgaacccgctactta

SEQ ID NO: 2938 - DNA, 38 bp, Artificial Sequence
  Synthetic oligonucleotide
ttgtcaagcgctatccaccatttctcttttatctatga

SEQ ID NO: 2939 - DNA, 35 bp, Artificial Sequence
  Synthetic oligonucleotide
caatgcgacgaggcttctatgtcatgaactaagct

SEQ ID NO: 2940 - DNA, 37 bp, Artificial Sequence
  Synthetic oligonucleotide
ccgaacggtcgcaaagtggtgtagcctctaatccgga

SEQ ID NO: 2941 - DNA, 35 bp, Artificial Sequence; identical to SEQ ID NO: 2877
  Synthetic oligonucleotide

SEQ ID NO: 2942 - DNA, 38 bp, Artificial Sequence
  Synthetic oligonucleotide
accggaatgtacatgccctggtttttgttattatttga

SEQ ID NO: 2943 - DNA, 35 bp, Artificial Sequence
  Synthetic oligonucleotide
accatgcgcccaccactattttttccacttcctta

SEQ ID NO: 2944 - DNA, 37 bp, Artificial Sequence
  Synthetic oligonucleotide
acggagtaccctgcccactatataacttaaaccttga

SEQ ID NO: 2945 - DNA, 35 bp, Artificial Sequence
  Synthetic oligonucleotide
acgggcgtgtcgcactgtctgtcactggcttattc

SEQ ID NO: 2946 - DNA, 35 bp, Artificial Sequence
  Synthetic oligonucleotide
agacggtgggtgggtgggtggtgctgcagtctacc

SEQ ID NO: 2947 - DNA, 35 bp, Artificial Sequence
  Synthetic oligonucleotide
catgccgcaccccaacacgtaccatttcattattt

SEQ ID NO: 2948 - DNA, 36 bp, Artificial Sequence
  Synthetic oligonucleotide
catgcgggcatccttagcttaacctcaattccatta

SEQ ID NO: 2949 - DNA, 35 bp, Artificial Sequence
  Synthetic oligonucleotide
catggccattctaccctccattccattccttgcct

SEQ ID NO: 2950 - DNA, 35 bp, Artificial Sequence
  Synthetic oligonucleotide
cgttcggtacgcagtcatttcactctatcttgttc

SEQ ID NO: 2951 - DNA, 37 bp, Artificial Sequence
  Synthetic oligonucleotide
aacccacgagttgttggtccacgcctcgttatcacga

SEQ ID NO: 2952 - DNA, 36 bp, Artificial Sequence
  Synthetic oligonucleotide
aacccatgcctgccccatgtgcattcaggcagagca

SEQ ID NO: 2953 - DNA, 36 bp, Artificial Sequence
  Synthetic oligonucleotide
accgccacagtcatcaacccacctggccgacgacga

SEQ ID NO: 2954 - DNA, 36 bp, Artificial Sequence
  Synthetic oligonucleotide
gacaacgcaaccgcaggctcatggagccaatatgta

SEQ ID NO: 2955 - DNA, 37 bp, Artificial Sequence
  Synthetic oligonucleotide
gacaacacgtcgcatgatcttaaaagaggacctagga

SEQ ID NO: 2956 - DNA, 38 bp, Artificial Sequence
  Synthetic oligonucleotide
gagtggtcgccactcacaacgatgcggtatccccttga

SEQ ID NO: 2957 - DNA, 37 bp, Artificial Sequence
  Synthetic oligonucleotide
gcgtggtggtccgccggtggtgagtcgatgaactgga

SEQ ID NO: 2958 - DNA, 36 bp, Artificial Sequence
  Synthetic oligonucleotide
gtgatcgatagcgagtgttgagctgtcgagagtgga

SEQ ID NO: 2959 - DNA, 36 bp, Artificial Sequence
  Synthetic oligonucleotide
tcacacaccgcgtggctcggacgacaagtagtccta

SEQ ID NO: 2960 - DNA, 35 bp, Artificial Sequence
  Synthetic oligonucleotide
tgaacctgcacagctgttaagaggtggcttacgta

SEQ ID NO: 2961 - DNA, 35 bp, Artificial Sequence
  Synthetic oligonucleotide
actgaccacagctacgtaagcaataaccgatcgtt

SEQ ID NO: 2962 - DNA, 35 bp, Artificial Sequence
  Synthetic oligonucleotide
aagagtacgggcatgagtaataagggagtagccgt

SEQ ID NO: 2963 - DNA, 35 bp, Artificial Sequence
  Synthetic oligonucleotide
agatcgcggtcaatcggtgggtagttaggatcggg

SEQ ID NO: 2964 - DNA, 35 bp, Artificial Sequence
  Synthetic oligonucleotide
gaacacacgtcgatcgccactgagagcagatgtca

SEQ ID NO: 2965 - DNA, 35 bp, Artificial Sequence
  Synthetic oligonucleotide
atcggaggccgtatcaccatatcccaccaccactt

SEQ ID NO: 2966 - DNA, 34 bp, Artificial Sequence
  Synthetic oligonucleotide
cttattttagcaagatcttttatctaaatacaat

SEQ ID NO: 2967 - DNA, 36 bp, Artificial Sequence
  Synthetic oligonucleotide
gacaaacgtagtgctgaacatggcgttctggtccaa

SEQ ID NO: 2968 - DNA, 35 bp, Artificial Sequence
  Synthetic oligonucleotide
ataccgggacaggcgacagaagggtgaaccaatgt

SEQ ID NO: 2969 - DNA, 37 bp, Artificial Sequence
  Synthetic oligonucleotide
gagtggacgtggacgcgaaacgggtcaggcataacga

SEQ ID NO: 2970 - DNA, 36 bp, Artificial Sequence
  Synthetic oligonucleotide
taccacgtggcgcctgacgacttacgcaactgggga

SEQ ID NO: 2971 - DNA, 36 bp, Artificial Sequence
  Synthetic oligonucleotide
tacagccgacatgaacatcccttaatcccaccctaa

SEQ ID NO: 2972 - DNA, 37 bp, Artificial Sequence
  Synthetic oligonucleotide
tgataccgcgcaacgagacttaccacgtcaggatgga

SEQ ID NO: 2973 - DNA, 36 bp, Artificial Sequence
  Synthetic oligonucleotide
atggtgggagcaccgacgtaggaggcctatggcgta

SEQ ID NO: 2974 - DNA, 37 bp, Artificial Sequence; identical to SEQ ID NO: 2955
  Synthetic oligonucleotide

SEQ ID NO: 2975 - DNA, 38 bp, Artificial Sequence
  Synthetic oligonucleotide
gtgaacgtcgctagaaacgatggtgtaaatagtcttga

SEQ ID NO: 2976 - DNA, 36 bp, Artificial Sequence; identical to SEQ ID NO: 2958
  Synthetic oligonucleotide

SEQ ID NO: 2977 - DNA, 37 bp, Artificial Sequence
  Synthetic oligonucleotide
aacacgcaacacacaactctcggcaaatccagcgcga

SEQ ID NO: 2978 - DNA, 37 bp, Artificial Sequence
  Synthetic oligonucleotide
acgacgcaccctgccactatcgtagatactccgacta

SEQ ID NO: 2979 - DNA, 36 bp, Artificial Sequence
  Synthetic oligonucleotide
gaccaatggaccggggactactctgagaaagcgcga

SEQ ID NO: 2980 - DNA, 36 bp, Artificial Sequence
  Synthetic oligonucleotide
agtggaacgcaccgaagttacctacctgagatggga

SEQ ID NO: 2981 - DNA, 37 bp, Artificial Sequence
  Synthetic oligonucleotide
gacgacggggatcctgacaattcctgactaagcgcga

SEQ ID NO: 2982 - DNA, 35 bp, Artificial Sequence
  Synthetic oligonucleotide
gacccgcccagtaagcacacacacagcccaaattt

SEQ ID NO: 2983 - DNA, 37 bp, Artificial Sequence
  Synthetic oligonucleotide
gagcggactcgaatagaactccgcaacaccagcgcga

SEQ ID NO: 2984 - DNA, 37 bp, Artificial Sequence
  Synthetic oligonucleotide
gagacgaggccgggatcatgctagggatcggacagga

SEQ ID NO: 2985 - DNA, 36 bp, Artificial Sequence
  Synthetic oligonucleotide
taccgacaccctcgtgttcccaaacaaggagacgga

SEQ ID NO: 2986 - DNA, 37 bp, Artificial Sequence
  Synthetic oligonucleotide
ggatacgcaccttaaggagggacgaataaaagcgcga

SEQ ID NO: 2987 - DNA, 36 bp, Artificial Sequence
  Synthetic oligonucleotide
tagcacagtggtgcttacggaacatcaccagcgcga

SEQ ID NO: 2988 - DNA, 37 bp, Artificial Sequence
  Synthetic oligonucleotide
tagtcggtcggcctgccgatgcgtcaaggtagcgcga

SEQ ID NO: 2989 - DNA, 37 bp, Artificial Sequence
  Synthetic oligonucleotide
taggaatcaccggctcgggcgaggccgggaagcgcga

SEQ ID NO: 2990 - DNA, 37 bp, Artificial Sequence
  Synthetic oligonucleotide
tgagccgcaaccggcaaacaaggcttcaacagcgcga

SEQ ID NO: 2991 - DNA, 36 bp, Artificial Sequence
  Synthetic oligonucleotide
aacaccacaccgccgctgatccggatggaacctcga

SEQ ID NO: 2992 - DNA, 35 bp, Artificial Sequence; identical to SEQ ID NO: 2962
  Synthetic oligonucleotide

SEQ ID NO: 2993 - DNA, 36 bp, Artificial Sequence
  Synthetic oligonucleotide
acacgtgccccaccaatatgcgataagactttgtta

SEQ ID NO: 2994 - DNA, 36 bp, Artificial Sequence
  Synthetic oligonucleotide
gacaccgaagacgaggctaaagagagaagtgccata

SEQ ID NO: 2995 - DNA, 35 bp, Artificial Sequence
  Synthetic oligonucleotide
atcgccgcacacctgccactcactcttccatcgct

SEQ ID NO: 2996 - DNA, 34 bp, Artificial Sequence; identical to SEQ ID NO: 2966
  Synthetic oligonucleotide

SEQ ID NO: 2997 - DNA, 36 bp, Artificial Sequence
  Synthetic oligonucleotide
gactaacgccgcttatcctcaacgcctaaccttgtt

SEQ ID NO: 2998 - DNA, 37 bp, Artificial Sequence
  Synthetic oligonucleotide
gagtggtcgcctgcaggtgcattccatccagctccga

SEQ ID NO: 2999 - DNA, 35 bp, Artificial Sequence
  Synthetic oligonucleotide
gtggaggctgcaatacggtgcaagagagcttaggg

SEQ ID NO: 3000 - DNA, 37 bp, Artificial Sequence
  Synthetic oligonucleotide
gtcaccgcatgcgggtcaagccctcaactttacttga

SEQ ID NO: 3001 - DNA, 37 bp, Artificial Sequence
  Synthetic oligonucleotide
taagtcgcgccccagtcagtgattgatacagatagga

SEQ ID NO: 3002 - DNA, 36 bp, Artificial Sequence
  Synthetic oligonucleotide
tcaacatgcgtgcaagtggcaccgttctcgtttcga

SEQ ID NO: 3003 - DNA, 34 bp, Artificial Sequence
  Synthetic oligonucleotide
tcttatttagcaagatcttttatctaaatacaat

SEQ ID NO: 3004 - DNA, 37 bp, Artificial Sequence; identical to SEQ ID NO: 2977
  Synthetic oligonucleotide

SEQ ID NO: 3005 - DNA, 37 bp, Artificial Sequence; identical to SEQ ID NO: 2978
  Synthetic oligonucleotide

SEQ ID NO: 3006 - DNA, 36 bp, Artificial Sequence; identical to SEQ ID NO: 2979
  Synthetic oligonucleotide

SEQ ID NO: 3007 - DNA, 37 bp, Artificial Sequence; identical to SEQ ID NO: 2981
  Synthetic oligonucleotide

SEQ ID NO: 3008 - DNA, 37 bp, Artificial Sequence; identical to SEQ ID NO: 2983
  Synthetic oligonucleotide

SEQ ID NO: 3009 - DNA, 37 bp, Artificial Sequence; identical to SEQ ID NO: 2984
  Synthetic oligonucleotide

SEQ ID NO: 3010 - DNA, 36 bp, Artificial Sequence
  Synthetic oligonucleotide
tacgcgggtggtcgaccccactagtagtcatccata

SEQ ID NO: 3011 - DNA, 36 bp, Artificial Sequence; identical to SEQ ID NO: 2985
  Synthetic oligonucleotide

SEQ ID NO: 3012 - DNA, 37 bp, Artificial Sequence; identical to SEQ ID NO: 2986
  Synthetic oligonucleotide

SEQ ID NO: 3013 - DNA, 36 bp, Artificial Sequence; identical to SEQ ID NO: 2987
  Synthetic oligonucleotide

SEQ ID NO: 3014 - DNA, 37 bp, Artificial Sequence; identical to SEQ ID NO: 2988
  Synthetic oligonucleotide

SEQ ID NO: 3015 - DNA, 37 bp, Artificial Sequence; identical to SEQ ID NO: 2989
  Synthetic oligonucleotide

SEQ ID NO: 3016 - DNA, 38 bp, Artificial Sequence
  Synthetic oligonucleotide
tccgaacgggacgtacaccaagccgagctctatcctga

SEQ ID NO: 3017 - DNA, 37 bp, Artificial Sequence; identical to SEQ ID NO: 2990
  Synthetic oligonucleotide

SEQ ID NO: 3018 - DNA, 36 bp, Artificial Sequence
  Synthetic oligonucleotide
accatcgggtcacgtaaaagcggttctaatttctaa

SEQ ID NO: 3019 - DNA, 35 bp, Artificial Sequence; identical to SEQ ID NO: 721
  Synthetic oligonucleotide

SEQ ID NO: 3020 - DNA, 36 bp, Artificial Sequence
  Synthetic oligonucleotide
gaacaggcgttccctactgatttatctgtccccata

SEQ ID NO: 3021 - DNA, 36 bp, Artificial Sequence
  Synthetic oligonucleotide
gaccatgcgagcggcaaagcacggaaaatgtttgaa

SEQ ID NO: 3022 - DNA, 38 bp, Artificial Sequence
  Synthetic oligonucleotide
gagtcatgtccgcctttaacccgacttaagaactttga

SEQ ID NO: 3023 - DNA, 38 bp, Artificial Sequence
  Synthetic oligonucleotide
gcaagatgaagttggtactttcctctctattcttttga

SEQ ID NO: 3024 - DNA, 37 bp, Artificial Sequence
  Synthetic oligonucleotide
gccacaccgcccgtacatacttcctcaccaacattga

SEQ ID NO: 3025 - DNA, 35 bp, Artificial Sequence
  Synthetic oligonucleotide
gcgcgcccaccagtatcttttggtctagataggca

SEQ ID NO: 3026 - DNA, 35 bp, Artificial Sequence
  Synthetic oligonucleotide
gggcccacgccaccgtttgtccacaggaaggatac

SEQ ID NO: 3027 - DNA, 37 bp, Artificial Sequence
  Synthetic oligonucleotide
gtgcggtcatggaattcttttaagcatgataatacga

SEQ ID NO: 3028 - DNA, 35 bp, Artificial Sequence
  Synthetic oligonucleotide
ttgcaaagcgcaccgtccgagccggtggcaccgaa

SEQ ID NO: 3029 - DNA, 37 bp, Artificial Sequence
  Synthetic oligonucleotide
ttcacgccacattcacgggaactgagagtgacgacga

SEQ ID NO: 3030 - DNA, 37 bp, Artificial Sequence
  Synthetic oligonucleotide
tttgcggtcattaacttgcgtgtaggacaccggtgga

SEQ ID NO: 3031 - DNA, 35 bp, Artificial Sequence
  Synthetic oligonucleotide
acgcagtgccgccgaatcctgatcccctaactttc

SEQ ID NO: 3032 - DNA, 35 bp, Artificial Sequence
  Synthetic oligonucleotide
aatgcgtccgacctaactgttgcgattcttctttt

SEQ ID NO: 3033 - DNA, 38 bp, Artificial Sequence
  Synthetic oligonucleotide
acacacaagtccatgcgggcctcacttttcgcctatga

SEQ ID NO: 3034 - DNA, 36 bp, Artificial Sequence
  Synthetic oligonucleotide
agtcccaactgcagggtttatacctctggttctctc

SEQ ID NO: 3035 - DNA, 36 bp, Artificial Sequence
  Synthetic oligonucleotide
gcacacgcccacattgtcctactagctattttatta

SEQ ID NO: 3036 - DNA, 38 bp, Artificial Sequence
  Synthetic oligonucleotide
gccgcccctgagtagttttcgtttttcttgtcctctga

SEQ ID NO: 3037 - DNA, 35 bp, Artificial Sequence
  Synthetic oligonucleotide
gcgatcgatatgttgcctatcctcttacgacatct

SEQ ID NO: 3038 - DNA, 35 bp, Artificial Sequence
  Synthetic oligonucleotide
gcgttgtccgtgtccatccatcttgtcatttgttt

SEQ ID NO: 3039 - DNA, 35 bp, Artificial Sequence
  Synthetic oligonucleotide
taacgtacaaccgggcgcacaggccattcttctac

SEQ ID NO: 3040 - DNA, 35 bp, Artificial Sequence
  Synthetic oligonucleotide
gttcggggtgcatgtcgtgaagccgctaacctctt

SEQ ID NO: 3041 - DNA, 38 bp, Artificial Sequence
  Synthetic oligonucleotide
tgctcagtcaagcgagtaccactacgcctattccgtga

SEQ ID NO: 3042 - DNA, 38 bp, Artificial Sequence
  Synthetic oligonucleotide
tgctaaacgtactggggcttcctcagatctttgcttga

SEQ ID NO: 3043 - DNA, 36 bp, Artificial Sequence
  Synthetic oligonucleotide
tgtacccccgccgtaatcatctatcttgtccccgaa

SEQ ID NO: 3044 - DNA, 35 bp, Artificial Sequence
  Synthetic oligonucleotide
accactgaactcatggtactaatcacacaccaatt

SEQ ID NO: 3045 - DNA, 37 bp, Artificial Sequence
  Synthetic oligonucleotide
actgtacagtagtccacgaacatatcgctttctatga

SEQ ID NO: 3046 - DNA, 38 bp, Artificial Sequence
  Synthetic oligonucleotide
accgcgcgctgcagtatatcccacttcgttctatatga

SEQ ID NO: 3047 - DNA, 35 bp, Artificial Sequence
  Synthetic oligonucleotide
agtggatcactgggcggagtgcgttaggaagacgg

SEQ ID NO: 3048 - DNA, 35 bp, Artificial Sequence
  Synthetic oligonucleotide
gattacgccttaagtggtactcagttatgaggaga

SEQ ID NO: 3049 - DNA, 37 bp, Artificial Sequence
  Synthetic oligonucleotide
gcgtaggtcatgcgacgtataaccttcccacaaatga

SEQ ID NO: 3050 - DNA, 37 bp, Artificial Sequence
  Synthetic oligonucleotide
tacaccaaaaagatcggtgattaccatgcaacaagga

SEQ ID NO: 3051 - DNA, 35 bp, Artificial Sequence
  Synthetic oligonucleotide
taccagacgtaccgcacacctttcatctgcctaac

SEQ ID NO: 3052 - DNA, 35 bp, Artificial Sequence
  Synthetic oligonucleotide
tttgagactgcgggctgtgcgttgctttgatatcc

SEQ ID NO: 3053 - DNA, 35 bp, Artificial Sequence
  Synthetic oligonucleotide
actgactgcatacatccgcatattaaacccgtatt

SEQ ID NO: 3054 - DNA, 36 bp, Artificial Sequence
  Synthetic oligonucleotide
acatctccaggattccccttcagccatggccctaca

SEQ ID NO: 3055 - DNA, 38 bp, Artificial Sequence
  Synthetic oligonucleotide
acgctcagctggcatgtaccccccctctctacacttga

SEQ ID NO: 3056 - DNA, 36 bp, Artificial Sequence
  Synthetic oligonucleotide
actcgcgtgtccaacacggactgcagtagcaatcca

SEQ ID NO: 3057 - DNA, 37 bp, Artificial Sequence
  Synthetic oligonucleotide
gcaggtggtgcaggttattcatgcgaaagggtactga

SEQ ID NO: 3058 - DNA, 36 bp, Artificial Sequence
  Synthetic oligonucleotide
gcggtggaaacgtaatcggacactgcgcatgcgaca

SEQ ID NO: 3059 - DNA, 36 bp, Artificial Sequence
  Synthetic oligonucleotide
tgaacctgcgatggtccgtgcgaacccgatctcaca

SEQ ID NO: 3060 - DNA, 35 bp, Artificial Sequence
  Synthetic oligonucleotide
tcacgtccccaacaacccggagtaattccctgcca

SEQ ID NO: 3061 - DNA, 35 bp, Artificial Sequence
  Synthetic oligonucleotide
tgggtacacatccggcatgccaataacgcttaagt

SEQ ID NO: 3062 - DNA, 35 bp, Artificial Sequence
  Synthetic oligonucleotide
acgcctgtacgatgtcctcggtctcattttatttc

SEQ ID NO: 3063 - DNA, 35 bp, Artificial Sequence
  Synthetic oligonucleotide
aaacgtcaagggaaagcgtagtctcctcgaccctt

SEQ ID NO: 3064 - DNA, 36 bp, Artificial Sequence
  Synthetic oligonucleotide
actgggaagtacgctgtcaggcatttgctaactaaa

SEQ ID NO: 3065 - DNA, 35 bp, Artificial Sequence
  Synthetic oligonucleotide
aatcattgcaggtatatgcgagcgaactacgattc

SEQ ID NO: 3066 - DNA, 35 bp, Artificial Sequence
  Synthetic oligonucleotide
atacgttccggccaactgaaacggagttcgggtct

SEQ ID NO: 3067 - DNA, 36 bp, Artificial Sequence
  Synthetic oligonucleotide
atgcatagctgcccttcttatccgtttccaactaca

SEQ ID NO: 3068 - DNA, 38 bp, Artificial Sequence
  Synthetic oligonucleotide
atgcgaaactgtaagcacccttccaccttgtaccatga

SEQ ID NO: 3069 - DNA, 38 bp, Artificial Sequence
  Synthetic oligonucleotide
gacgccgaaacactaagcttttaacacttacgatatga

SEQ ID NO: 3070 - DNA, 35 bp, Artificial Sequence
  Synthetic oligonucleotide
attatcccagcgatcccgagtcccggcatttactg

SEQ ID NO: 3071 - DNA, 36 bp, Artificial Sequence
  Synthetic oligonucleotide
catgcgcatatcgctccgttcgttcctcaatttcca

SEQ ID NO: 3072 - DNA, 38 bp, Artificial Sequence
  Synthetic oligonucleotide
gcccgaacccgaaaaccgatcgcctgaatcccaattga

SEQ ID NO: 3073 - DNA, 35 bp, Artificial Sequence
  Synthetic oligonucleotide
gcaggctcgcgtagcttcaaactagcagaccacgt

SEQ ID NO: 3074 - DNA, 38 bp, Artificial Sequence
  Synthetic oligonucleotide
gcacgggacgcaagctagactacacaccgactttttga

SEQ ID NO: 3075 - DNA, 38 bp, Artificial Sequence
  Synthetic oligonucleotide
gctggcactgcgaatatcgatctacactatcccactga

SEQ ID NO: 3076 - DNA, 36 bp, Artificial Sequence
  Synthetic oligonucleotide
gctagcacacaggatccctctttattagcacttcaa

SEQ ID NO: 3077 - DNA, 35 bp, Artificial Sequence
  Synthetic oligonucleotide
tatgcgacccgttaaacccgtactcttcctaaact

SEQ ID NO: 3078 - DNA, 38 bp, Artificial Sequence
  Synthetic oligonucleotide
tagtcatgcgcgcatctcaaaatttacttctcaaatga

SEQ ID NO: 3079 - DNA, 38 bp, Artificial Sequence
  Synthetic oligonucleotide
tctacactccgctccttgacctaatttaaagaccttga

SEQ ID NO: 3080 - DNA, 35 bp, Artificial Sequence
  Synthetic oligonucleotide
tcgcggaaacctgcccctgcatcgtagccatccac

SEQ ID NO: 3081 - DNA, 36 bp, Artificial Sequence
  Synthetic oligonucleotide
ttcaccaccacccctttggacccttttaccgagaga

SEQ ID NO: 3082 - DNA, 36 bp, Artificial Sequence
  Synthetic oligonucleotide
ttgcagacctcatttacgcacttgggacttctgcca

SEQ ID NO: 3083 - DNA, 37 bp, Artificial Sequence
  Synthetic oligonucleotide
ttggcacctccactgcttgttctcgattcatgtgcga

SEQ ID NO: 3084 - DNA, 35 bp, Artificial Sequence
  Synthetic oligonucleotide
actgcggtcatcgagttactggctattgcctgacc

SEQ ID NO: 3085 - DNA, 36 bp, Artificial Sequence
  Synthetic oligonucleotide
cccgcggtaatagtgcgggcggacgcggtcatgaca

SEQ ID NO: 3086 - DNA, 36 bp, Artificial Sequence
  Synthetic oligonucleotide
gaacgtagactgactacggtccacacgcccattgta

SEQ ID NO: 3087 - DNA, 35 bp, Artificial Sequence
  Synthetic oligonucleotide
ccaacgacagatatggacgtgctgcgggggcaatc

SEQ ID NO: 3088 - DNA, 35 bp, Artificial Sequence
  Synthetic oligonucleotide
atgcgatgtcacgtgacgtgagtaaccgcccaccc

SEQ ID NO: 3089 - DNA, 35 bp, Artificial Sequence
  Synthetic oligonucleotide
gcccacccttgccagcatgtatgcttgcatgtaac

SEQ ID NO: 3090 - DNA, 35 bp, Artificial Sequence
  Synthetic oligonucleotide
gccggtcatgcggtttgcacaccactccattctac

SEQ ID NO: 3091 - DNA, 36 bp, Artificial Sequence
  Synthetic oligonucleotide
gccaggcccattccttgcgggaggttaacaccagca

SEQ ID NO: 3092 - DNA, 36 bp, Artificial Sequence; identical to SEQ ID NO: 3058
  Synthetic oligonucleotide

SEQ ID NO: 3093 - DNA, 37 bp, Artificial Sequence
  Synthetic oligonucleotide
gtttcaccccggctgggctagttctgttaatgcgaga

SEQ ID NO: 3094 - DNA, 36 bp, Artificial Sequence
  Synthetic oligonucleotide
tgtaccgcggttgcgactatttccttactgcccata

SEQ ID NO: 3095 - DNA, 35 bp, Artificial Sequence
  Synthetic oligonucleotide
ttcgcgacgataactagttgcatgtctgaattcac

SEQ ID NO: 3096 - DNA, 37 bp, Artificial Sequence
  Synthetic oligonucleotide
tgtcactgcacgatgagactttcggcgaatatactga

SEQ ID NO: 3097 - DNA, 36 bp, Artificial Sequence
  Synthetic oligonucleotide
aatgcattgcgttatttcaattgaggcgtcctaaaa

SEQ ID NO: 3098 - DNA, 38 bp, Artificial Sequence
  Synthetic oligonucleotide
gcactgccaactttcttctggggactatttagctttga

SEQ ID NO: 3099 - DNA, 36 bp, Artificial Sequence
  Synthetic oligonucleotide
ggtaccaaaagtactgccatgagagccacttcccaa

SEQ ID NO: 3100 - DNA, 35 bp, Artificial Sequence
  Synthetic oligonucleotide
catacgcacggtcctctactataattgtccaccaa

SEQ ID NO: 3101 - DNA, 35 bp, Artificial Sequence
  Synthetic oligonucleotide
atgctgcggtaatggagccggttcttaaactgcct

SEQ ID NO: 3102 - DNA, 36 bp, Artificial Sequence
  Synthetic oligonucleotide
agttactgacaggcgcgtctttcgcaacactttata

SEQ ID NO: 3103 - DNA, 35 bp, Artificial Sequence
  Synthetic oligonucleotide
gcacccgagcctaatagtcctctattccccttcca

SEQ ID NO: 3104 - DNA, 36 bp, Artificial Sequence
  Synthetic oligonucleotide
gcgagcagtccatggcccatcctcgacttaacctca

SEQ ID NO: 3105 - DNA, 36 bp, Artificial Sequence
  Synthetic oligonucleotide
ggtagcaggcataccctacggaacagttctgtggca

SEQ ID NO: 3106 - DNA, 36 bp, Artificial Sequence
  Synthetic oligonucleotide
taggcacgtgcatcaggcgttctttgcccctgttta

SEQ ID NO: 3107 - DNA, 35 bp, Artificial Sequence
  Synthetic oligonucleotide
tgtgcagtcagtgaacggtgacctagttatgattt

SEQ ID NO: 3108 - DNA, 38 bp, Artificial Sequence
  Synthetic oligonucleotide
agcccgttgctacgttgcagtaggtgtaacttcactga

SEQ ID NO: 3109 - DNA, 38 bp, Artificial Sequence
  Synthetic oligonucleotide
actaactgcaagcgcccttggcccgatttgacctttga

SEQ ID NO: 3110 - DNA, 35 bp, Artificial Sequence
  Synthetic oligonucleotide
actaccgcaaactgcactgtttaaaactccttgaa

SEQ ID NO: 3111 - DNA, 35 bp, Artificial Sequence
  Synthetic oligonucleotide
acgactatcgtacatgtgcgtagtttagattccaa

SEQ ID NO: 3112 - DNA, 37 bp, Artificial Sequence
  Synthetic oligonucleotide
agttgaccacggagtgtactgcaatggagtgtaccga

SEQ ID NO: 3113 - DNA, 36 bp, Artificial Sequence
  Synthetic oligonucleotide
gaacgagcccggatgttaggatcctcgatttgcgta

SEQ ID NO: 3114 - DNA, 35 bp, Artificial Sequence
  Synthetic oligonucleotide
agtgctgccactaagctagaaaagttttcatgccc

SEQ ID NO: 3115 - DNA, 36 bp, Artificial Sequence
  Synthetic oligonucleotide
atcgtaacggactgctatttgtacggatccctataa

SEQ ID NO: 3116 - DNA, 38 bp, Artificial Sequence
  Synthetic oligonucleotide
gcagtctagcgcccgcttgtaccacatcctcgctttga

SEQ ID NO: 3117 - DNA, 35 bp, Artificial Sequence
  Synthetic oligonucleotide
tgtactgagtgcacaacacgtgatgatgatatctt

SEQ ID NO: 3118 - DNA, 36 bp, Artificial Sequence
  Synthetic oligonucleotide
agcggtcaccgcctatggttattcatttttctctta

SEQ ID NO: 3119 - DNA, 35 bp, Artificial Sequence
  Synthetic oligonucleotide
actcagcgatgccctaacttggacgttcggctact

SEQ ID NO: 3120 - DNA, 35 bp, Artificial Sequence
  Synthetic oligonucleotide
cacaccgacgaaactgtcctcgcctactacctatc

SEQ ID NO: 3121 - DNA, 35 bp, Artificial Sequence
  Synthetic oligonucleotide
agtgaggcgtcacggctattactccgtgctaattt

SEQ ID NO: 3122 - DNA, 35 bp, Artificial Sequence; identical to SEQ ID NO: 3100
  Synthetic oligonucleotide

SEQ ID NO: 3123 - DNA, 35 bp, Artificial Sequence
  Synthetic oligonucleotide
gaaacggccatgaaccttttaatctttccaccttt

SEQ ID NO: 3124 - DNA, 36 bp, Artificial Sequence
  Synthetic oligonucleotide
gcgagaggatcaccgtgaggcttcccaactatttta

SEQ ID NO: 3125 - DNA, 35 bp, Artificial Sequence
  Synthetic oligonucleotide
gcgaggcgccctccaacccaacccattcaatggta

SEQ ID NO: 3126 - DNA, 35 bp, Artificial Sequence
  Synthetic oligonucleotide
gcgcagtccgtccacatttggtctactgctttcct

SEQ ID NO: 3127 - DNA, 35 bp, Artificial Sequence
  Synthetic oligonucleotide
gtgcgcctacatatatctcggttacaacctttttc

SEQ ID NO: 3128 - DNA, 35 bp, Artificial Sequence
  Synthetic oligonucleotide
tgcatcccaccactatgatatacctaatgccctct

SEQ ID NO: 3129 - DNA, 36 bp, Artificial Sequence
  Synthetic oligonucleotide
tgcaggccgcatcacctcttgtgccggttcatcaaa

SEQ ID NO: 3130 - DNA, 38 bp, Artificial Sequence
  Synthetic oligonucleotide
tgcgaggctagcttgttgccactatttggtccttatga

SEQ ID NO: 3131 - DNA, 38 bp, Artificial Sequence; identical to SEQ ID NO: 3108
  Synthetic oligonucleotide

SEQ ID NO: 3132 - DNA, 35 bp, Artificial Sequence
  Synthetic oligonucleotide
agggcaacgaacgcaggaatccctcattcctacgg

SEQ ID NO: 3133 - DNA, 35 bp, Artificial Sequence; identical to SEQ ID NO: 3114
  Synthetic oligonucleotide

SEQ ID NO: 3134 - DNA, 35 bp, Artificial Sequence
  Synthetic oligonucleotide
atcctcgttacgtgcacggacttctcatgcgaact

SEQ ID NO: 3135 - DNA, 36 bp, Artificial Sequence
  Synthetic oligonucleotide
gcccaggtttgacgactgccgtgcgctcggtcttaa

SEQ ID NO: 3136 - DNA, 37 bp, Artificial Sequence
  Synthetic oligonucleotide
ggtcatggcgcaacttcatcttttcacacctgattga

SEQ ID NO: 3137 - DNA, 36 bp, Artificial Sequence; identical to SEQ ID NO: 3105
  Synthetic oligonucleotide

SEQ ID NO: 3138 - DNA, 35 bp, Artificial Sequence
  Synthetic oligonucleotide
tcccgcaattacgcagaccgactacgattccaaaa

SEQ ID NO: 3139 - DNA, 38 bp, Artificial Sequence
  Synthetic oligonucleotide
tgtacgtaggtaagcgatacacactgcacccctactga

SEQ ID NO: 3140 - DNA, 35 bp, Artificial Sequence
  Synthetic oligonucleotide
tgacctctgcagtggccagcccattctttagcttc

SEQ ID NO: 3141 - DNA, 35 bp, Artificial Sequence
  Synthetic oligonucleotide
ttactgcaggtgcgatcgcgttctccaacatctct

SEQ ID NO: 3142 - DNA, 37 bp, Artificial Sequence
  Synthetic oligonucleotide
accacgttggttattgccctgctttgaagtcttacga

SEQ ID NO: 3143 - DNA, 36 bp, Artificial Sequence
  Synthetic oligonucleotide
aacacactgcgcctttactttaattttcgattatta

SEQ ID NO: 3144 - DNA, 35 bp, Artificial Sequence
  Synthetic oligonucleotide
agcaccgacgtgataggactgtaatgccctcctct

SEQ ID NO: 3145 - DNA, 35 bp, Artificial Sequence
  Synthetic oligonucleotide
atgcgcgagtcataaggcgtttcttttcactggct

SEQ ID NO: 3146 - DNA, 35 bp, Artificial Sequence
  Synthetic oligonucleotide
atgcgacatgcgttacaataatccgcgcaagccgc

SEQ ID NO: 3147 - DNA, 35 bp, Artificial Sequence
  Synthetic oligonucleotide
gagtgcgcgtacaatttgtcctcttgccgcttttt

SEQ ID NO: 3148 - DNA, 35 bp, Artificial Sequence
  Synthetic oligonucleotide
taagtcatgggcctcatctatacctgatcgatctc

SEQ ID NO: 3149 - DNA, 36 bp, Artificial Sequence
  Synthetic oligonucleotide
tcaggcgggatatgcgctcagggaagcggggagcaa

SEQ ID NO: 3150 - DNA, 37 bp, Artificial Sequence
  Synthetic oligonucleotide
tgagctcgacctgccgtcgtacaatttcccttactga

SEQ ID NO: 3151 - DNA, 38 bp, Artificial Sequence
  Synthetic oligonucleotide
acttaccgcttaatacacttgccggaccttgtgcttga

SEQ ID NO: 3152 - DNA, 35 bp, Artificial Sequence
  Synthetic oligonucleotide
actatagccacctaacccagcactaaacccacgca

SEQ ID NO: 3153 - DNA, 35 bp, Artificial Sequence
  Synthetic oligonucleotide
acccccccgcttcgtgcacttcactcccgaaatcc

SEQ ID NO: 3154 - DNA, 35 bp, Artificial Sequence
  Synthetic oligonucleotide
gccgcaccataactttagcctacccagtgccctgc

SEQ ID NO: 3155 - DNA, 36 bp, Artificial Sequence
  Synthetic oligonucleotide
tgccaccaaatacccaaccctagagtagccttatta

SEQ ID NO: 3156 - DNA, 37 bp, Artificial Sequence
  Synthetic oligonucleotide
actctagccacttgatccaccacgtcggttcccacga

SEQ ID NO: 3157 - DNA, 35 bp, Artificial Sequence
  Synthetic oligonucleotide
ttagcgataaacacatcatcccggacacgccgtgt

SEQ ID NO: 3158 - DNA, 38 bp, Artificial Sequence
  Synthetic oligonucleotide
taccgtcgctcaaaaccggcctaccctaaacccactga

SEQ ID NO: 3159 - DNA, 37 bp, Artificial Sequence
  Synthetic oligonucleotide
accgccgctctactctgtcaccgaacgccctttggga

SEQ ID NO: 3160 - DNA, 38 bp, Artificial Sequence
  Synthetic oligonucleotide
agcccgacccgcttgcctaaacccacccatgacactga

SEQ ID NO: 3161 - DNA, 35 bp, Artificial Sequence
  Synthetic oligonucleotide
aggtacccaccgcaaagcaccagtaaccacaaccc

SEQ ID NO: 3162 - DNA, 37 bp, Artificial Sequence
  Synthetic oligonucleotide
gcatccgaccaatagacccacacatctgtaccaaaga

SEQ ID NO: 3163 - DNA, 35 bp, Artificial Sequence
  Synthetic oligonucleotide
tcccgccgctaccgtaagccactccgaagtactca

SEQ ID NO: 3164 - DNA, 35 bp, Artificial Sequence
  Synthetic oligonucleotide
acgccagaccacccgatatccccccaaatggtaac

SEQ ID NO: 3165 - DNA, 38 bp, Artificial Sequence
  Synthetic oligonucleotide
aaacccacttcttacccggtaatctgccgaccgcatga

SEQ ID NO: 3166 - DNA, 35 bp, Artificial Sequence
  Synthetic oligonucleotide
acgcgtgggctactaaactccatcaccccgtgccc

SEQ ID NO: 3167 - DNA, 36 bp, Artificial Sequence
  Synthetic oligonucleotide
actattccgcatcattgagcacccgaccgaccaaaa

SEQ ID NO: 3168 - DNA, 35 bp, Artificial Sequence
  Synthetic oligonucleotide
acacaaaggctataaccgccgactctccaccagcc

SEQ ID NO: 3169 - DNA, 36 bp, Artificial Sequence
  Synthetic oligonucleotide
accaacaccaaccttctacgccgtaccctctgcaaa

SEQ ID NO: 3170 - DNA, 35 bp, Artificial Sequence
  Synthetic oligonucleotide
aaaccgctatttaccccggaccacgttgacaccga

SEQ ID NO: 3171 - DNA, 37 bp, Artificial Sequence
  Synthetic oligonucleotide
tacgtccaccccgaatcctaattcatacacctaaaga

SEQ ID NO: 3172 - DNA, 36 bp, Artificial Sequence
  Synthetic oligonucleotide
aaatgccacatcacttattcaccccgcgcaccccga

SEQ ID NO: 3173 - DNA, 37 bp, Artificial Sequence
  Synthetic oligonucleotide
acaatcaccttacaccttacgacctgcttaatagaga

SEQ ID NO: 3174 - DNA, 35 bp, Artificial Sequence
  Synthetic oligonucleotide
gttcgtgtacgtcgcattaaccctaccataaaacc

SEQ ID NO: 3175 - DNA, 37 bp, Artificial Sequence
  Synthetic oligonucleotide
gcgtatcaaaaaacccaccgctaactaccacaaccga

SEQ ID NO: 3176 - DNA, 38 bp, Artificial Sequence
  Synthetic oligonucleotide
gtgaacccacctgcgccctacactattaaacgagctga

SEQ ID NO: 3177 - DNA, 35 bp, Artificial Sequence
  Synthetic oligonucleotide
tcaacatgcccacatacaccagacacactatacac

SEQ ID NO: 3178 - DNA, 35 bp, Artificial Sequence
  Synthetic oligonucleotide
catgcaacccgcacttaggcgcgagccaattacca

SEQ ID NO: 3179 - DNA, 37 bp, Artificial Sequence
  Synthetic oligonucleotide
acccccaatccttataccataaacacatgaccggtga

SEQ ID NO: 3180 - DNA, 37 bp, Artificial Sequence
  Synthetic oligonucleotide
accggtcaaccccccacagaacatttcccgtcaccga

SEQ ID NO: 3181 - DNA, 37 bp, Artificial Sequence
  Synthetic oligonucleotide
acatgaatccaactaaaacccgctccgtgccgaacga

SEQ ID NO: 3182 - DNA, 35 bp, Artificial Sequence
  Synthetic oligonucleotide
atcccccaaacacaaacgcgagtttcccgggtcca

SEQ ID NO: 3183 - DNA, 38 bp, Artificial Sequence
  Synthetic oligonucleotide
ctctgcgcgagtcaccctcacctagatccctgatatga

SEQ ID NO: 3184 - DNA, 35 bp, Artificial Sequence
  Synthetic oligonucleotide
ctacccaacggtcacacccaccgcgtatccactac

SEQ ID NO: 3185 - DNA, 35 bp, Artificial Sequence
  Synthetic oligonucleotide
ttacacccgtcaactaaccatacccacgagagagc

SEQ ID NO: 3186 - DNA, 34 bp, Artificial Sequence
  Synthetic oligonucleotide
accccactactaccctctcgtccgcctaactgtc

SEQ ID NO: 3187 - DNA, 36 bp, Artificial Sequence
  Synthetic oligonucleotide
accagtccatatcccgccattgtgtcgttcgatcga

SEQ ID NO: 3188 - DNA, 37 bp, Artificial Sequence
  Synthetic oligonucleotide
gccaccccctaccctaacgacccaatatgactggtga

SEQ ID NO: 3189 - DNA, 38 bp, Artificial Sequence
  Synthetic oligonucleotide
caccaaatatcaagtgcctctctaaccttctgacctga

SEQ ID NO: 3190 - DNA, 36 bp, Artificial Sequence
  Synthetic oligonucleotide
actgtcactaccccacgcgcaaccaacaaataccca

SEQ ID NO: 3191 - DNA, 37 bp, Artificial Sequence
  Synthetic oligonucleotide
agctcgactaaaccacccgtataaaagctatacccga

SEQ ID NO: 3192 - DNA, 35 bp, Artificial Sequence
  Synthetic oligonucleotide
gagcgccctacttcaactcccaaaccacatgaccg

SEQ ID NO: 3193 - DNA, 35 bp, Artificial Sequence
  Synthetic oligonucleotide
aacaaagttcacccatcccacaaccccaattcgac

SEQ ID NO: 3194 - DNA, 37 bp, Artificial Sequence
  Synthetic oligonucleotide
cttctgacccgtagaccacaacttcccgacttcccga

SEQ ID NO: 3195 - DNA, 35 bp, Artificial Sequence
  Synthetic oligonucleotide
accccataccattaactccggattccccagtgctc

SEQ ID NO: 3196 - DNA, 38 bp, Artificial Sequence
  Synthetic oligonucleotide
agccacccacaaaacgcgcaatcagtaaacccacctga

SEQ ID NO: 3197 - DNA, 35 bp, Artificial Sequence
  Synthetic oligonucleotide
tcctaacgctgtcgacgccaccacccggacccact

SEQ ID NO: 3198 - DNA, 36 bp, Artificial Sequence
  Synthetic oligonucleotide
ccaatacccccgcgcccaatcccacacgttatcgta

SEQ ID NO: 3199 - DNA, 36 bp, Artificial Sequence
  Synthetic oligonucleotide
agcttacccactcccgaaagacaccctgacaccgta

SEQ ID NO: 3200 - DNA, 36 bp, Artificial Sequence
  Synthetic oligonucleotide
atgacctaatccaccacccctgcacctcagtctaca

SEQ ID NO: 3201 - DNA, 35 bp, Artificial Sequence
  Synthetic oligonucleotide
atcccgcacacctaaagcaaacgtggcttaggtcc

SEQ ID NO: 3202 - DNA, 37 bp, Artificial Sequence
  Synthetic oligonucleotide
atcctccgcccgggcactaaccagctcctgaccacga

SEQ ID NO: 3203 - DNA, 35 bp, Artificial Sequence
  Synthetic oligonucleotide
actgcgcccatcagataccaaaacctgcaaaccgc

SEQ ID NO: 3204 - DNA, 36 bp, Artificial Sequence
  Synthetic oligonucleotide
gccacccgcctttagccctacagatacacacactaa

SEQ ID NO: 3205 - DNA, 36 bp, Artificial Sequence
  Synthetic oligonucleotide
accccctacgccggctgactaaaccgcacaccctca

SEQ ID NO: 3206 - DNA, 36 bp, Artificial Sequence
  Synthetic oligonucleotide
gtttaccgtacccccttgcactgcccgaccaaccca

SEQ ID NO: 3207 - DNA, 35 bp, Artificial Sequence
  Synthetic oligonucleotide
actggaaccccaatcggagcgaagcctgactaccg

SEQ ID NO: 3208 - DNA, 37 bp, Artificial Sequence
  Synthetic oligonucleotide
tgccaacctaccataccatcaattgacagatacctga

SEQ ID NO: 3209 - DNA, 37 bp, Artificial Sequence
  Synthetic oligonucleotide
tcacccacgccatatactgcactccaaaccccgctga

SEQ ID NO: 3210 - DNA, 36 bp, Artificial Sequence
  Synthetic oligonucleotide
aaactgttcctgtgacaaaaccctcaacccatacca

SEQ ID NO: 3211 - DNA, 37 bp, Artificial Sequence
  Synthetic oligonucleotide
acgccacctacccacctcactatgaaatatactcgga

SEQ ID NO: 3212 - DNA, 35 bp, Artificial Sequence
  Synthetic oligonucleotide
gtccccttaagtccacccatacacgttactgaccc

SEQ ID NO: 3213 - DNA, 37 bp, Artificial Sequence
  Synthetic oligonucleotide
gagaacccaccagcaccaattcacaaacacttacgga

SEQ ID NO: 3214 - DNA, 36 bp, Artificial Sequence
  Synthetic oligonucleotide
acaagcctaacccgacccctagttctcacgttgaca

SEQ ID NO: 3215 - DNA, 38 bp, Artificial Sequence
  Synthetic oligonucleotide
acaccctccaaagcacaaacctacccattagccaatga

SEQ ID NO: 3216 - DNA, 36 bp, Artificial Sequence
  Synthetic oligonucleotide
aagtaccccaactcactgtaggtcactacgacaaca

SEQ ID NO: 3217 - DNA, 35 bp, Artificial Sequence
  Synthetic oligonucleotide
acgccgacccgatattttagcaaatatcacctacc

SEQ ID NO: 3218 - DNA, 38 bp, Artificial Sequence
  Synthetic oligonucleotide
acgttaacacccgcctcccacacccacttgacaggtga

SEQ ID NO: 3219 - DNA, 35 bp, Artificial Sequence
  Synthetic oligonucleotide
catcaagcagtcaacctgactcatcccatgtaccc

SEQ ID NO: 3220 - DNA, 37 bp, Artificial Sequence
  Synthetic oligonucleotide
acgcagttccaccacccattgtcaccaagatcatcga

SEQ ID NO: 3221 - DNA, 37 bp, Artificial Sequence
  Synthetic oligonucleotide
ctatgcaacacccgccttcgcacgttcacactaccga

SEQ ID NO: 3222 - DNA, 35 bp, Artificial Sequence
  Synthetic oligonucleotide
agcatgacacggcacctaccacccgaacgaccatc

SEQ ID NO: 3223 - DNA, 37 bp, Artificial Sequence
  Synthetic oligonucleotide
ttaataccgatttacacgctacccgtcccgggaggga

SEQ ID NO: 3224 - DNA, 37 bp, Artificial Sequence
  Synthetic oligonucleotide
aatacgctccagctcacctaaccctactaatcctcga

SEQ ID NO: 3225 - DNA, 35 bp, Artificial Sequence
  Synthetic oligonucleotide
acggaacaatcccccactatgctccacttcttact

SEQ ID NO: 3226 - DNA, 35 bp, Artificial Sequence
  Synthetic oligonucleotide
gcacacaaacattccaccaggtgacaaccccgaca

SEQ ID NO: 3227 - DNA, 37 bp, Artificial Sequence
  Synthetic oligonucleotide
atccgctctcacgacgccgaccaaacacattccggga

SEQ ID NO: 3228 - DNA, 35 bp, Artificial Sequence
  Synthetic oligonucleotide
tctgcacgcgaagctccgccgaccacaatacaaac

SEQ ID NO: 3229 - DNA, 36 bp, Artificial Sequence
  Synthetic oligonucleotide
tgaaatcgaccacttgagagcgtacttaagcacccg

SEQ ID NO: 3230 - DNA, 34 bp, Artificial Sequence
  Synthetic oligonucleotide
aaccgaatcccaggacctaactcatcccatgaaa

SEQ ID NO: 3231 - DNA, 35 bp, Artificial Sequence
  Synthetic oligonucleotide
atcctcctctgacctcgatctcccttaccaaacgg

SEQ ID NO: 3232 - DNA, 38 bp, Artificial Sequence
  Synthetic oligonucleotide
tggtccaacccccacgccgccatcactggacaacttga

SEQ ID NO: 3233 - DNA, 36 bp, Artificial Sequence
  Synthetic oligonucleotide
gcaccgcgcctctaccctacttacctaccccatcaa

SEQ ID NO: 3234 - DNA, 36 bp, Artificial Sequence
  Synthetic oligonucleotide
ggggcgcacgaaatcagaacaaccctaaaaccccta

SEQ ID NO: 3235 - DNA, 38 bp, Artificial Sequence
  Synthetic oligonucleotide
gactacccgctcactcacccgtcccaaattagatatga

SEQ ID NO: 3236 - DNA, 35 bp, Artificial Sequence
  Synthetic oligonucleotide
tacgccatcaaacccgatacctaaatttagcacac

SEQ ID NO: 3237 - DNA, 36 bp, Artificial Sequence
  Synthetic oligonucleotide
ttgcagaacacgaccaccaccgctttagagccacca

SEQ ID NO: 3238 - DNA, 35 bp, Artificial Sequence
  Synthetic oligonucleotide
taactcggtcctgatgctctacccgtatcaaccct

SEQ ID NO: 3239 - DNA, 35 bp, Artificial Sequence
  Synthetic oligonucleotide
ccgcatcccacagaactcggctactcaaaccacta

SEQ ID NO: 3240 - DNA, 35 bp, Artificial Sequence
  Synthetic oligonucleotide
gcagcactccacatcatcaaccatccacaaacctc

SEQ ID NO: 3241 - DNA, 35 bp, Artificial Sequence
  Synthetic oligonucleotide
actacatagaaggacccaaacatccctaccgcgct

SEQ ID NO: 3242 - DNA, 35 bp, Artificial Sequence
  Synthetic oligonucleotide
aacggcctaacacttagaaacctgactagccctac

SEQ ID NO: 3243 - DNA, 35 bp, Artificial Sequence
  Synthetic oligonucleotide
gccccgccgggctatccgcgacctagcctccctct

SEQ ID NO: 3244 - DNA, 36 bp, Artificial Sequence
  Synthetic oligonucleotide
gagtaatgctacccacaacccgcctaaaccatatca

SEQ ID NO: 3245 - DNA, 37 bp, Artificial Sequence
  Synthetic oligonucleotide
ctcactagactcccaactaaccttcttgctccctaga

SEQ ID NO: 3246 - DNA, 38 bp, Artificial Sequence
  Synthetic oligonucleotide
gaaactcaaacacactaagatcctaatcatatccatga

SEQ ID NO: 3247 - DNA, 38 bp, Artificial Sequence
  Synthetic oligonucleotide
gtcgtagcacgctccttacacgctttaatcctagatga

SEQ ID NO: 3248 - DNA, 35 bp, Artificial Sequence
  Synthetic oligonucleotide
aacgaaacggtctgctaccaccatccccacacacc

SEQ ID NO: 3249 - DNA, 35 bp, Artificial Sequence
  Synthetic oligonucleotide
ccccagagaacccgcacctagtcacacgaccactt

SEQ ID NO: 3250 - DNA, 35 bp, Artificial Sequence
  Synthetic oligonucleotide
ccgagtaccgtcattaatcaactagccgacaccac

SEQ ID NO: 3251 - DNA, 37 bp, Artificial Sequence
  Synthetic oligonucleotide
actgcccgattgtcgctggaattccgctatctccgga

SEQ ID NO: 3252 - DNA, 36 bp, Artificial Sequence
  Synthetic oligonucleotide
tgcgtccccacgaaaccatagccaacccaccggaca

SEQ ID NO: 3253 - DNA, 36 bp, Artificial Sequence
  Synthetic oligonucleotide
accgcaggtcatttcccagtactaccgacagacgca

SEQ ID NO: 3254 - DNA, 35 bp, Artificial Sequence
  Synthetic oligonucleotide
gcccttatgcaaaacccgcggaccggagaccatac

SEQ ID NO: 3255 - DNA, 38 bp, Artificial Sequence
  Synthetic oligonucleotide
acccataagcctagaaccaccctatcacacgaagttga

SEQ ID NO: 3256 - DNA, 37 bp, Artificial Sequence
  Synthetic oligonucleotide
tagtccgagcacgcctataaaatgagccctaattctg

SEQ ID NO: 3257 - DNA, 35 bp, Artificial Sequence
  Synthetic oligonucleotide
cacaccactcgtagctgtctgtcccccgctttagt

SEQ ID NO: 3258 - DNA, 37 bp, Artificial Sequence
  Synthetic oligonucleotide
cgttaccgtactaatcccacccaggcctattcgtgga

SEQ ID NO: 3259 - DNA, 36 bp, Artificial Sequence
  Synthetic oligonucleotide
gcccggggcccactagatccagactcaacaccgcca

SEQ ID NO: 3260 - DNA, 34 bp, Artificial Sequence
  Synthetic oligonucleotide
ccagcatatgccctacccgcatccgatcaactat

SEQ ID NO: 3261 - DNA, 35 bp, Artificial Sequence
  Synthetic oligonucleotide
tccatatcaaaccaccctaaccagacgaatcgggc

SEQ ID NO: 3262 - DNA, 37 bp, Artificial Sequence
  Synthetic oligonucleotide
acctttgaccgcccatgaactcaccgggggacggtga

SEQ ID NO: 3263 - DNA, 35 bp, Artificial Sequence
  Synthetic oligonucleotide
ccatcccgctccctgtaacggaatcactcccctcc

SEQ ID NO: 3264 - DNA, 35 bp, Artificial Sequence
  Synthetic oligonucleotide
cctgcacaccgatacaatgcctaaaaccgcatgtc

SEQ ID NO: 3265 - DNA, 37 bp, Artificial Sequence
  Synthetic oligonucleotide
gcctctgaatcaacccgctagcacttctagacttgga

SEQ ID NO: 3266 - DNA, 37 bp, Artificial Sequence
  Synthetic oligonucleotide
aacgtcaaaaactccgcgccattaaccccaaccggga

SEQ ID NO: 3267 - DNA, 37 bp, Artificial Sequence
  Synthetic oligonucleotide
ttatctacttagcccgcccttactacagtccgcagga

SEQ ID NO: 3268 - DNA, 37 bp, Artificial Sequence
  Synthetic oligonucleotide
ttcacgccgacccgaccctgctttaaagagttcacga

SEQ ID NO: 3269 - DNA, 35 bp, Artificial Sequence
  Synthetic oligonucleotide
agtcactcaccgcgcacgaacgaaacccgctgcac

SEQ ID NO: 3270 - DNA, 38 bp, Artificial Sequence
  Synthetic oligonucleotide
gtccgttcttgtcccgccaaaccatagtaatccgatga

SEQ ID NO: 3271 - DNA, 38 bp, Artificial Sequence
  Synthetic oligonucleotide
actctcaatcctcaggctctgcccttccaaccagatga

SEQ ID NO: 3272 - DNA, 38 bp, Artificial Sequence
  Synthetic oligonucleotide
aacccctattccgtggacactcctatcatgcacgctga

SEQ ID NO: 3273 - DNA, 35 bp, Artificial Sequence
  Synthetic oligonucleotide
accaataaccaactatataccttagatgacttgaa

SEQ ID NO: 3274 - DNA, 37 bp, Artificial Sequence
  Synthetic oligonucleotide
gaccctcagtgcctaccccagtgcaaacaattctgga

SEQ ID NO: 3275 - DNA, 38 bp, Artificial Sequence
  Synthetic oligonucleotide
acaccgtgcccaaactatacggaccacaccgactatga

SEQ ID NO: 3276 - DNA, 36 bp, Artificial Sequence
  Synthetic oligonucleotide
aacctgtcttttcgctatcccacatccgagagacca

SEQ ID NO: 3277 - DNA, 38 bp, Artificial Sequence
  Synthetic oligonucleotide
aaacccgcatctgggaaccggccccaacttggccttga

SEQ ID NO: 3278 - DNA, 37 bp, Artificial Sequence
  Synthetic oligonucleotide
tccgccagtacgcatccaatatagtccggactatgga

SEQ ID NO: 3279 - DNA, 36 bp, Artificial Sequence
  Synthetic oligonucleotide
tgacacgaacgttatgcaatcccgactctggacaaa

SEQ ID NO: 3280 - DNA, 35 bp, Artificial Sequence
  Synthetic oligonucleotide
gcctggcactatactgagtccatccgtacatcccg

SEQ ID NO: 3281 - DNA, 36 bp, Artificial Sequence
  Synthetic oligonucleotide
aatcgtacaggtgtctcccccaccaccccgcgaaaa

SEQ ID NO: 3282 - DNA, 36 bp, Artificial Sequence
  Synthetic oligonucleotide
aacccgcaccccacaactgctacctactggtgcata

SEQ ID NO: 3283 - DNA, 35 bp, Artificial Sequence
  Synthetic oligonucleotide
acaaccccgcaccgttactgccacctctactcacg

SEQ ID NO: 3284 - DNA, 38 bp, Artificial Sequence
  Synthetic oligonucleotide
gaggcattatatcatcccgcatccaatatagaccatga

SEQ ID NO: 3285 - DNA, 37 bp, Artificial Sequence
  Synthetic oligonucleotide
gtcgcgttctacgccccaaccctagctcccttccaga

SEQ ID NO: 3286 - DNA, 36 bp, Artificial Sequence
  Synthetic oligonucleotide
acccaagcaagaatccgactatagctcacctagaca

SEQ ID NO: 3287 - DNA, 37 bp, Artificial Sequence
  Synthetic oligonucleotide
tcttgcacctgcccgcctcagtagactacccgctgga

SEQ ID NO: 3288 - DNA, 38 bp, Artificial Sequence
  Synthetic oligonucleotide
aagttactcctccatctctgcacatggcactagcatga

SEQ ID NO: 3289 - DNA, 36 bp, Artificial Sequence
  Synthetic oligonucleotide
atgcaggcaattaggacatttcactctcgcccgtga

SEQ ID NO: 3290 - DNA, 38 bp, Artificial Sequence
  Synthetic oligonucleotide
acccatattgatccccaccaccaccatcaacgttctga

SEQ ID NO: 3291 - DNA, 37 bp, Artificial Sequence
  Synthetic oligonucleotide
aaagcccagtaactcccggaagattagtaccccccga

SEQ ID NO: 3292 - DNA, 37 bp, Artificial Sequence
  Synthetic oligonucleotide
acttaaggagatcctccccactacacatacccaaaga

SEQ ID NO: 3293 - DNA, 36 bp, Artificial Sequence
  Synthetic oligonucleotide
cccaaatacctattcccgccagtccacgcttatgta

SEQ ID NO: 3294 - DNA, 35 bp, Artificial Sequence
  Synthetic oligonucleotide
aggcacctattacgtccaacccatcccactcggtc

SEQ ID NO: 3295 - DNA, 36 bp, Artificial Sequence
  Synthetic oligonucleotide
acccgccacgaaagcccgactaggtaatacgccgta

SEQ ID NO: 3296 - DNA, 37 bp, Artificial Sequence
  Synthetic oligonucleotide
atcgctccgtttaaatcctaaacccacagccgcttga

SEQ ID NO: 3297 - DNA, 38 bp, Artificial Sequence
  Synthetic oligonucleotide
tgtcatcccacctaaacggggaccatgcatctaaatga

SEQ ID NO: 3298 - DNA, 36 bp, Artificial Sequence
  Synthetic oligonucleotide
gagcactgagtctgacccacaccgcacaggggacta

SEQ ID NO: 3299 - DNA, 38 bp, Artificial Sequence
  Synthetic oligonucleotide
ggtaatccgcctccacacttgcgtgtcccatcatatga

SEQ ID NO: 3300 - DNA, 38 bp, Artificial Sequence
  Synthetic oligonucleotide
tgacaatgacggacccgatactaacccgcagtacttga

SEQ ID NO: 3301 - DNA, 35 bp, Artificial Sequence
  Synthetic oligonucleotide
ggagaaacgtacttgccatccaccccggacatacc

SEQ ID NO: 3302 - DNA, 37 bp, Artificial Sequence
  Synthetic oligonucleotide
acatttgccgcctattcgggcccgcctatcctgtaga

SEQ ID NO: 3303 - DNA, 38 bp, Artificial Sequence
  Synthetic oligonucleotide
acgctcgccgccttttcctagctgtatcccaatgatga

SEQ ID NO: 3304 - DNA, 36 bp, Artificial Sequence
  Synthetic oligonucleotide
cctcgccgcttctgccctacgagtaccccaactaca

SEQ ID NO: 3305 - DNA, 37 bp, Artificial Sequence
  Synthetic oligonucleotide
acccgcccgcttacctgagatatcgagagccccatga

SEQ ID NO: 3306 - DNA, 35 bp, Artificial Sequence
  Synthetic oligonucleotide
ttcccgtccggtactgccctaatcataaagaaacg

SEQ ID NO: 3307 - DNA, 37 bp, Artificial Sequence
  Synthetic oligonucleotide
gtgggtcatcacttcccgcaaatcccgattcctacga

SEQ ID NO: 3308 - DNA, 35 bp, Artificial Sequence
  Synthetic oligonucleotide
acaccgctttgctcggcgacttatcccaaatggta

SEQ ID NO: 3309 - DNA, 37 bp, Artificial Sequence
  Synthetic oligonucleotide
gcgtatcaaaaaacccaccgctaactacaacaaccga

SEQ ID NO: 3310 - DNA, 37 bp, Artificial Sequence
  Synthetic oligonucleotide
ggcccgcctgccaccgaaaacgcgagtacttccaaga

SEQ ID NO: 3311 - DNA, 35 bp, Artificial Sequence
  Synthetic oligonucleotide
gccccagcgcccacctcattccaaatccacgcaat

SEQ ID NO: 3312 - DNA, 37 bp, Artificial Sequence
  Synthetic oligonucleotide
ctcaggctgcaactacccaggttacccatcacttcga

SEQ ID NO: 3313 - DNA, 35 bp, Artificial Sequence
  Synthetic oligonucleotide
acgccgtttctgtgctaccaaccccctgtgctact

SEQ ID NO: 3314 - DNA, 36 bp, Artificial Sequence
  Synthetic oligonucleotide
aaccaccaactctacgcgagttatcctgcccgacga

SEQ ID NO: 3315 - DNA, 36 bp, Artificial Sequence
  Synthetic oligonucleotide
ccctaccacccgaaaacttgaaatcacccgcgtata

SEQ ID NO: 3316 - DNA, 35 bp, Artificial Sequence
  Synthetic oligonucleotide
gacactgcactctgtaccccaacctatgcctctac

SEQ ID NO: 3317 - DNA, 38 bp, Artificial Sequence
  Synthetic oligonucleotide
ctactataatccgctccaccaaaaaatagcctcagtga

SEQ ID NO: 3318 - DNA, 38 bp, Artificial Sequence
  Synthetic oligonucleotide
aggtgtcaactgccactacatccacctgtttccgatga

SEQ ID NO: 3319 - DNA, 38 bp, Artificial Sequence
  Synthetic oligonucleotide
tgtagtattgccttccctcttccgctataaaatgatga

SEQ ID NO: 3320 - DNA, 37 bp, Artificial Sequence
  Synthetic oligonucleotide
gagaacgcccattcgataaccaaaccaacttataaga

SEQ ID NO: 3321 - DNA, 38 bp, Artificial Sequence
  Synthetic oligonucleotide
aggtcatttctactccgattgccagtcaccgatcgtga

SEQ ID NO: 3322 - DNA, 36 bp, Artificial Sequence
  Synthetic oligonucleotide
acttccttggcctggattctacccaataagaactca

SEQ ID NO: 3323 - DNA, 35 bp, Artificial Sequence
  Synthetic oligonucleotide
cttacaaatccttgcctacgacccgaccactggcc

SEQ ID NO: 3324 - DNA, 37 bp, Artificial Sequence
  Synthetic oligonucleotide
gtgcgcctactgctcctacctctgaccacatgtgtga

SEQ ID NO: 3325 - DNA, 35 bp, Artificial Sequence
  Synthetic oligonucleotide
cccctgcctaaaccggttagtgccttgccgctccc

SEQ ID NO: 3326 - DNA, 37 bp, Artificial Sequence
  Synthetic oligonucleotide
actgagtgcatcccacgtactttacaaatccgactga

SEQ ID NO: 3327 - DNA, 35 bp, Artificial Sequence
  Synthetic oligonucleotide
aatccgatcttaccgctatctgataccgagaatta

SEQ ID NO: 3328 - DNA, 38 bp, Artificial Sequence
  Synthetic oligonucleotide
cccaccattacgacctataccccatgttacacgtatga

SEQ ID NO: 3329 - DNA, 35 bp, Artificial Sequence
  Synthetic oligonucleotide
caccgccttagtcccgtaaatactatgctcctctg

SEQ ID NO: 3330 - DNA, 37 bp, Artificial Sequence
  Synthetic oligonucleotide
acagtatacatcacacccctcattttcggagtgccga

SEQ ID NO: 3331 - DNA, 38 bp, Artificial Sequence
  Synthetic oligonucleotide
gcccagtaccggtccaccccgcttccgtactaccctga

SEQ ID NO: 3332 - DNA, 36 bp, Artificial Sequence
  Synthetic oligonucleotide
gaacgtcaccgtatcccccgcatgatcagggcccca

SEQ ID NO: 3333 - DNA, 37 bp, Artificial Sequence
  Synthetic oligonucleotide
gcgcctacgattgacaccgccggaacatacccacaga

SEQ ID NO: 3334 - DNA, 38 bp, Artificial Sequence
  Synthetic oligonucleotide
tattgccccaagatcgacccaacctcaacgcccaatta

SEQ ID NO: 3335 - DNA, 38 bp, Artificial Sequence
  Synthetic oligonucleotide
tccactaccggcgccgacgggccgcatgtaatttctga

SEQ ID NO: 3336 - DNA, 37 bp, Artificial Sequence
  Synthetic oligonucleotide
tcaccaaacgtcatccttcacccgagactgtagggga

SEQ ID NO: 3337 - DNA, 35 bp, Artificial Sequence
  Synthetic oligonucleotide
accgcctctatcggaactttgcttagatactacgc

SEQ ID NO: 3338 - DNA, 37 bp, Artificial Sequence
  Synthetic oligonucleotide
ggacaaaaaacaccttagccccaaatcactaccacta

SEQ ID NO: 3339 - DNA, 37 bp, Artificial Sequence
  Synthetic oligonucleotide
cgcgagccacacctccgcacatttaccctcgggatga

SEQ ID NO: 3340 - DNA, 38 bp, Artificial Sequence
  Synthetic oligonucleotide
ttgtggcttcacccatcaatctcctctgggtctactga

SEQ ID NO: 3341 - DNA, 36 bp, Artificial Sequence
  Synthetic oligonucleotide
ctctgctgactatacccatcataacacgcgagccta

SEQ ID NO: 3342 - DNA, 37 bp, Artificial Sequence
  Synthetic oligonucleotide
taacagcccgacacacccgaactactatggacactga

SEQ ID NO: 3343 - DNA, 38 bp, Artificial Sequence
  Synthetic oligonucleotide
acaccgcatctgccctcggtcaccctacacatcattga

SEQ ID NO: 3344 - DNA, 35 bp, Artificial Sequence
  Synthetic oligonucleotide
actgcctacactacttcgtgcgaacgatagctctt

SEQ ID NO: 3345 - DNA, 35 bp, Artificial Sequence
  Synthetic oligonucleotide
aattccgctctcctgaacgcttggagtcccattca

SEQ ID NO: 3346 - DNA, 35 bp, Artificial Sequence
  Synthetic oligonucleotide
tgctggtcatcacaaccgacgataacgcttaatat

SEQ ID NO: 3347 - DNA, 35 bp, Artificial Sequence
  Synthetic oligonucleotide
gtgacggaacctactactgcactgaaccaccgccc

SEQ ID NO: 3348 - DNA, 35 bp, Artificial Sequence
  Synthetic oligonucleotide
gcccgcgattcacgctccacttaatccgataacct

SEQ ID NO: 3349 - DNA, 37 bp, Artificial Sequence
  Synthetic oligonucleotide
gatatgatcccacttcctagacacctatattacctga

SEQ ID NO: 3350 - DNA, 36 bp, Artificial Sequence
  Synthetic oligonucleotide
cttatctgctgtccctttcgcttggatcacgattaa

SEQ ID NO: 3351 - DNA, 37 bp, Artificial Sequence
  Synthetic oligonucleotide
aatcaactctcatgccgcccatcagtccacgttatga

SEQ ID NO: 3352 - DNA, 36 bp, Artificial Sequence
  Synthetic oligonucleotide
cgcttactcgtactcatcatcacgtgacattcacta

SEQ ID NO: 3353 - DNA, 36 bp, Artificial Sequence
  Synthetic oligonucleotide
tccctatccccccgccagtaaaacccacatgacgga

SEQ ID NO: 3354 - DNA, 36 bp, Artificial Sequence
  Synthetic oligonucleotide
actccatattcacgataacccacagatccgttaaaa

SEQ ID NO: 3355 - DNA, 37 bp, Artificial Sequence
  Synthetic oligonucleotide
tccatcccgactaatttttagacctttgctacacaga

SEQ ID NO: 3356 - DNA, 37 bp, Artificial Sequence
  Synthetic oligonucleotide
gcgttcgttctatactttctaacgttctttacacaga

SEQ ID NO: 3357 - DNA, 37 bp, Artificial Sequence
  Synthetic oligonucleotide
taccggataacaacgccaattttcattaatttcaaga

SEQ ID NO: 3358 - DNA, 37 bp, Artificial Sequence
  Synthetic oligonucleotide
ggactacacgtgagcgcttattctttgactttacaga

SEQ ID NO: 3359 - DNA, 35 bp, Artificial Sequence
  Synthetic oligonucleotide
atcacgggagtgatagtctgggccctgaaactact

SEQ ID NO: 3360 - DNA, 35 bp, Artificial Sequence
  Synthetic oligonucleotide
aaatcccatcgagcccttaacccagaccaactcaa

SEQ ID NO: 3361 - DNA, 35 bp, Artificial Sequence
  Synthetic oligonucleotide
atcatcccggcttttgagtaaaccagcttttcacc

SEQ ID NO: 3362 - DNA, 35 bp, Artificial Sequence
  Synthetic oligonucleotide
gagtacttgactctggtatattttttctccccatt

SEQ ID NO: 3363 - DNA, 35 bp, Artificial Sequence
  Synthetic oligonucleotide
actttacacccgcgaacaatattacctccccgaac

SEQ ID NO: 3364 - DNA, 37 bp, Artificial Sequence
  Synthetic oligonucleotide
aacctggccattacactttccttttgagttctctaga

SEQ ID NO: 3365 - DNA, 36 bp, Artificial Sequence
  Synthetic oligonucleotide
gagtaggcctctgcactcccttctcgagatccgtaa

SEQ ID NO: 3366 - DNA, 35 bp, Artificial Sequence
  Synthetic oligonucleotide
tcttggaggacttttttttgacggttttttgtggt

SEQ ID NO: 3367 - DNA, 37 bp, Artificial Sequence
  Synthetic oligonucleotide
acgcacatctcattccgaataccttacgaataacaga

SEQ ID NO: 3368 - DNA, 37 bp, Artificial Sequence
  Synthetic oligonucleotide
gacctatacatatccgcgcacataaactcgaactaga

SEQ ID NO: 3369 - DNA, 35 bp, Artificial Sequence
  Synthetic oligonucleotide
ggaccgtttttgttttattgatgccgattgaccgc

SEQ ID NO: 3370 - DNA, 38 bp, Artificial Sequence
  Synthetic oligonucleotide
atcttttgcctgatcgcttcgaaattcgttccgcctga

SEQ ID NO: 3371 - DNA, 37 bp, Artificial Sequence
  Synthetic oligonucleotide
ttttgcatatacccttggttcttgttccatccgagga

SEQ ID NO: 3372 - DNA, 35 bp, Artificial Sequence
  Synthetic oligonucleotide
atttttgcaacatttgaaatttgggcattgggaac

SEQ ID NO: 3373 - DNA, 36 bp, Artificial Sequence
  Synthetic oligonucleotide
gagcacttaatttgtttgtatactgatggttttggt

SEQ ID NO: 3374 - DNA, 38 bp, Artificial Sequence
  Synthetic oligonucleotide
cgtagtaccggtctacttcattgcccacttgtatttga

SEQ ID NO: 3375 - DNA, 38 bp, Artificial Sequence
  Synthetic oligonucleotide
atgtggtggcctgaattgagtcctttttgttttgctga

SEQ ID NO: 3376 - DNA, 37 bp, Artificial Sequence
  Synthetic oligonucleotide
acttaccctggtgcactgaaagtgaacatttgtttga

SEQ ID NO: 3377 - DNA, 37 bp, Artificial Sequence
  Synthetic oligonucleotide
ttgcaactataggttgcattggtttttcgatacttga

SEQ ID NO: 3378 - DNA, 35 bp, Artificial Sequence
  Synthetic oligonucleotide
gacgctactaagtgtcgtgggattttttgctctct

SEQ ID NO: 3379 - DNA, 35 bp, Artificial Sequence
  Synthetic oligonucleotide
gcctggattactttgtgagagtttttggggtttgc

SEQ ID NO: 3380 - DNA, 35 bp, Artificial Sequence
  Synthetic oligonucleotide
ggtatagcggtcttgcaaacttgcaaaatcctctt

SEQ ID NO: 3381 - DNA, 38 bp, Artificial Sequence
  Synthetic oligonucleotide
gagtagttccggtcgtttacgggcttttgtttatttga

SEQ ID NO: 3382 - DNA, 38 bp, Artificial Sequence
  Synthetic oligonucleotide
tgggactttgccgcgaagctcttttctgttatctatga

SEQ ID NO: 3383 - DNA, 35 bp, Artificial Sequence
  Synthetic oligonucleotide
gattcgtagcctttaagttttggattgttgcctct

SEQ ID NO: 3384 - DNA, 35 bp, Artificial Sequence
  Synthetic oligonucleotide
ggggccatttagtatgttgtttctttttacgatgc

SEQ ID NO: 3385 - DNA, 38 bp, Artificial Sequence
  Synthetic oligonucleotide
aaatcgaaatcgggccttttgaaacattgccttagtga

SEQ ID NO: 3386 - DNA, 38 bp, Artificial Sequence
  Synthetic oligonucleotide
ggggctaatcgttcgaatttcgctgtgccatttcttga

SEQ ID NO: 3387 - DNA, 37 bp, Artificial Sequence
  Synthetic oligonucleotide
tttcggatattaactttgcgacctcggggtctatcga

SEQ ID NO: 3388 - DNA, 38 bp, Artificial Sequence
  Synthetic oligonucleotide
tgcattctctcggttagttctgtctgtttttgttttga

SEQ ID NO: 3389 - DNA, 37 bp, Artificial Sequence
  Synthetic oligonucleotide
ttcactctacctctctcttgctctgggcttatagtga

SEQ ID NO: 3390 - DNA, 38 bp, Artificial Sequence
  Synthetic oligonucleotide
ggtttcgaattgttagttcctttagtatgatgccttga

SEQ ID NO: 3391 - DNA, 38 bp, Artificial Sequence
  Synthetic oligonucleotide
gaattgccttagttggaattgatgttatttgtttttga

SEQ ID NO: 3392 - DNA, 38 bp, Artificial Sequence
  Synthetic oligonucleotide
atttcctgcgtgggttcgcctcgaattgcccatcttga

SEQ ID NO: 3393 - DNA, 38 bp, Artificial Sequence
  Synthetic oligonucleotide
gcggagaagctttgtatgttttccaccttggttattga

SEQ ID NO: 3394 - DNA, 35 bp, Artificial Sequence
  Synthetic oligonucleotide
gaaccagctgttgattttaccgccttgcccttttc

SEQ ID NO: 3395 - DNA, 37 bp, Artificial Sequence
  Synthetic oligonucleotide
attttgcccgtgattcttattttgtcgctgattgaga

SEQ ID NO: 3396 - DNA, 37 bp, Artificial Sequence
  Synthetic oligonucleotide
tgcccccggtgtttgctttacctgtaagttttcgtga

SEQ ID NO: 3397 - DNA, 36 bp, Artificial Sequence
  Synthetic oligonucleotide
gctcaccgcgaatattttgcttgggatttctgggga

SEQ ID NO: 3398 - DNA, 35 bp, Artificial Sequence
  Synthetic oligonucleotide
agccttaatgaatgaaccatcaacgaattgctctt

SEQ ID NO: 3399 - DNA, 38 bp, Artificial Sequence
  Synthetic oligonucleotide
gtgacgattgcgaaattgacttctcctcttctgtatga

SEQ ID NO: 3400 - DNA, 38 bp, Artificial Sequence
  Synthetic oligonucleotide
gagttgaatgttacccctctgcacaatattttagttga

SEQ ID NO: 3401 - DNA, 38 bp, Artificial Sequence
  Synthetic oligonucleotide
gcgcaccttggggtttagtcatattacttggttcttga

SEQ ID NO: 3402 - DNA, 38 bp, Artificial Sequence
  Synthetic oligonucleotide
ttttggcctaactccgggtttcgctttcctgcctgtga

SEQ ID NO: 3403 - DNA, 36 bp, Artificial Sequence
  Synthetic oligonucleotide
gagtgaggtttgatttgcctattttcagaggggttc

SEQ ID NO: 3404 - DNA, 38 bp, Artificial Sequence
  Synthetic oligonucleotide
gacggtggtcttggggggggttttgttttccagtatga

SEQ ID NO: 3405 - DNA, 37 bp, Artificial Sequence
  Synthetic oligonucleotide
ttcaggtaggagcatttggtggtcttcgctttcttga

SEQ ID NO: 3406 - DNA, 35 bp, Artificial Sequence
  Synthetic oligonucleotide
tcgggtaggttatccctgtatcaccttttttttgc

SEQ ID NO: 3407 - DNA, 38 bp, Artificial Sequence
  Synthetic oligonucleotide
tcactcatgcacttttgagctttgttgctgaattttga

SEQ ID NO: 3408 - DNA, 38 bp, Artificial Sequence
  Synthetic oligonucleotide
acacgcgctttggttattgtgcttttgcttcaccgtga

SEQ ID NO: 3409 - DNA, 35 bp, Artificial Sequence
  Synthetic oligonucleotide
ttatatctggttgacttttttttgcgggttgcacc

SEQ ID NO: 3410 - DNA, 38 bp, Artificial Sequence
  Synthetic oligonucleotide
ggttgcttatgggtcgtaccatttgcatgattctttga

SEQ ID NO: 3411 - DNA, 37 bp, Artificial Sequence
  Synthetic oligonucleotide
tgcccgtccttggttttcacgtgatttgattgtgcga

SEQ ID NO: 3412 - DNA, 37 bp, Artificial Sequence
  Synthetic oligonucleotide
tgcttctgtaagcggagctattaataggtatctttga

SEQ ID NO: 3413 - DNA, 38 bp, Artificial Sequence
  Synthetic oligonucleotide
ttttccatggttgtttttgcctcatcctctcctagtga

SEQ ID NO: 3414 - DNA, 38 bp, Artificial Sequence
  Synthetic oligonucleotide
agcaccccgatcgttaggggttctgttaaattctttga

SEQ ID NO: 3415 - DNA, 36 bp, Artificial Sequence
  Synthetic oligonucleotide
atttcttgccgttgccctgtttttttgtttatgaaa

SEQ ID NO: 3416 - DNA, 38 bp, Artificial Sequence
  Synthetic oligonucleotide
ttatgcaattttcttccgcttggaccataacaggttga

SEQ ID NO: 3417 - DNA, 38 bp, Artificial Sequence
  Synthetic oligonucleotide
tctttggtccgtgtaaataattttgcctgcttttttga

SEQ ID NO: 3418 - DNA, 35 bp, Artificial Sequence
  Synthetic oligonucleotide
aacgcgtactgagcaataaagcttttgccgtgttt

SEQ ID NO: 3419 - DNA, 38 bp, Artificial Sequence
  Synthetic oligonucleotide
agtgagtcgacgacgacgtttctcgatatcccccttga

SEQ ID NO: 3420 - DNA, 37 bp, Artificial Sequence
  Synthetic oligonucleotide
tttgttccattttttatgcattgttttcagtacgtga

SEQ ID NO: 3421 - DNA, 38 bp, Artificial Sequence
  Synthetic oligonucleotide
ttttagctctcatttggttgaggattattctgctttga

SEQ ID NO: 3422 - DNA, 37 bp, Artificial Sequence
  Synthetic oligonucleotide
ttccttagggggtttgacctcatggtccttcgtgtga

SEQ ID NO: 3423 - DNA, 38 bp, Artificial Sequence
  Synthetic oligonucleotide
ttacaatgattttcgaaccgggggttcgagctatttga

SEQ ID NO: 3424 - DNA, 35 bp, Artificial Sequence
  Synthetic oligonucleotide
gttcgcttggccgtggacttcctatattaaatttg

SEQ ID NO: 3425 - DNA, 35 bp, Artificial Sequence
  Synthetic oligonucleotide
gcccttttgctttttgagggatttaacatgcttgg

SEQ ID NO: 3426 - DNA, 35 bp, Artificial Sequence
  Synthetic oligonucleotide
ggaaatagaattgtaggattctctagtgcttttct

SEQ ID NO: 3427 - DNA, 36 bp, Artificial Sequence
  Synthetic oligonucleotide
gaccgtgttcggaccggatgtccgacttcttcttga

SEQ ID NO: 3428 - DNA, 38 bp, Artificial Sequence
  Synthetic oligonucleotide
gagtaatcgtaaattttgccccgctggctctggcttga

SEQ ID NO: 3429 - DNA, 35 bp, Artificial Sequence
  Synthetic oligonucleotide
ttactccttgacgattgtgagttctctttagaagc

SEQ ID NO: 3430 - DNA, 38 bp, Artificial Sequence
  Synthetic oligonucleotide
gcacgggaaggtactgctcgtcatattaacttggttga

SEQ ID NO: 3431 - DNA, 37 bp, Artificial Sequence
  Synthetic oligonucleotide
tccgtagatccgccccaagcatgggtttttagtttga

SEQ ID NO: 3432 - DNA, 36 bp, Artificial Sequence
  Synthetic oligonucleotide
ttctatgcaaagctccaacggtggagtggttttcta

SEQ ID NO: 3433 - DNA, 38 bp, Artificial Sequence
  Synthetic oligonucleotide
tctttatctagcttggtgggctatgcaagcccatttga

SEQ ID NO: 3434 - DNA, 38 bp, Artificial Sequence
  Synthetic oligonucleotide
atcccgttttttacctttgtgagcattatgccgcttga

SEQ ID NO: 3435 - DNA, 37 bp, Artificial Sequence
  Synthetic oligonucleotide
gttttcgcgagttatttccgtaatctgctcttagtga

SEQ ID NO: 3436 - DNA, 35 bp, Artificial Sequence
  Synthetic oligonucleotide
aaattaaacctttgcgcgttttggtgccctttgaa

SEQ ID NO: 3437 - DNA, 36 bp, Artificial Sequence
  Synthetic oligonucleotide
ttttgccgttttccatttatccgtgtaaatgattca

SEQ ID NO: 3438 - DNA, 36 bp, Artificial Sequence
  Synthetic oligonucleotide
gtggtaccatttgactccaacggtgattattgctta

SEQ ID NO: 3439 - DNA, 38 bp, Artificial Sequence
  Synthetic oligonucleotide
gcggtcgttttgacttgtcttcggtctcattggattga

SEQ ID NO: 3440 - DNA, 36 bp, Artificial Sequence
  Synthetic oligonucleotide
gagtggaacgttagctttactttggtgggatcttga

SEQ ID NO: 3441 - DNA, 37 bp, Artificial Sequence
  Synthetic oligonucleotide
acggttcgcactgttcaacgtggtttctccttgggga

SEQ ID NO: 3442 - DNA, 35 bp, Artificial Sequence
  Synthetic oligonucleotide
attgctgtgcctgactatttgaacctttgaccgta

SEQ ID NO: 3443 - DNA, 36 bp, Artificial Sequence
  Synthetic oligonucleotide
attgtttttatttttgccatagggtgtgccttagta

SEQ ID NO: 3444 - DNA, 37 bp, Artificial Sequence
  Synthetic oligonucleotide
acgtcaaccatatgattagctttgttgcccttggaga

SEQ ID NO: 3445 - DNA, 38 bp, Artificial Sequence
  Synthetic oligonucleotide
atttcaaattgctttgctggacggtgctccttacttga

SEQ ID NO: 3446 - DNA, 35 bp, Artificial Sequence
  Synthetic oligonucleotide
tttgcatgaagccattgaccggattggattcttta

SEQ ID NO: 3447 - DNA, 38 bp, Artificial Sequence
  Synthetic oligonucleotide
tcctggagcttctacgtaaatttgatgccttttgatga

SEQ ID NO: 3448 - DNA, 37 bp, Artificial Sequence
  Synthetic oligonucleotide
acagaggtacgttgattctcctcccttgttagcccta

SEQ ID NO: 3449 - DNA, 38 bp, Artificial Sequence
  Synthetic oligonucleotide
attgcatggggattctgcctatgttggttctgttttga

SEQ ID NO: 3450 - DNA, 35 bp, Artificial Sequence
  Synthetic oligonucleotide
gccacgtattcatcacatggggggatgtccttgtt

SEQ ID NO: 3451 - DNA, 36 bp, Artificial Sequence
  Synthetic oligonucleotide
aatgcatcgatgagccattgacttgtttggtttgta

SEQ ID NO: 3452 - DNA, 35 bp, Artificial Sequence
  Synthetic oligonucleotide
attttgatcacatgtgttgtgtaccatttgctatt

SEQ ID NO: 3453 - DNA, 35 bp, Artificial Sequence
  Synthetic oligonucleotide
tgtttgttgcccgctcggcgcagttaccctttgct

SEQ ID NO: 3454 - DNA, 38 bp, Artificial Sequence
  Synthetic oligonucleotide
tgccacccgtgtttggggccctagtgtttttttcgtga

SEQ ID NO: 3455 - DNA, 38 bp, Artificial Sequence
  Synthetic oligonucleotide
cgtcagtaattgcagcatgacaatttcctgcttgttga

SEQ ID NO: 3456 - DNA, 38 bp, Artificial Sequence
  Synthetic oligonucleotide
tgttccctgattttgccactggacctagtaggatttga

SEQ ID NO: 3457 - DNA, 35 bp, Artificial Sequence
  Synthetic oligonucleotide
catgccgaaacgatggtttggatcgtgctcctctg

SEQ ID NO: 3458 - DNA, 38 bp, Artificial Sequence
  Synthetic oligonucleotide
ttcgctatccgggtgatcgctgtggaggtatttcttga

SEQ ID NO: 3459 - DNA, 38 bp, Artificial Sequence
  Synthetic oligonucleotide
tctaattttttgcgtggttctggcctatcaaagtttga

SEQ ID NO: 3460 - DNA, 38 bp, Artificial Sequence
  Synthetic oligonucleotide
gcttccttctgggtgacgggtgatccccgtgcttgtga

SEQ ID NO: 3461 - DNA, 36 bp, Artificial Sequence
  Synthetic oligonucleotide
gagtacactcaattttagtttggtgcatgccctgca

SEQ ID NO: 3462 - DNA, 37 bp, Artificial Sequence
  Synthetic oligonucleotide
ttgctctgttcttaccgcccagtgaacgcgtgttcga

SEQ ID NO: 3463 - DNA, 38 bp, Artificial Sequence
  Synthetic oligonucleotide
acgtgcacaatgttggattgtttttgccctttgtatga

SEQ ID NO: 3464 - DNA, 37 bp, Artificial Sequence
  Synthetic oligonucleotide
tatttgcccgattgtgaaggtgtagcccttgatctga

SEQ ID NO: 3465 - DNA, 38 bp, Artificial Sequence
  Synthetic oligonucleotide
tcgacttgccagggacttttgcatccgccttgatatga

SEQ ID NO: 3466 - DNA, 35 bp, Artificial Sequence
  Synthetic oligonucleotide
gcagggccgcctgttaaggttcctaatttgccgtt

SEQ ID NO: 3467 - DNA, 37 bp, Artificial Sequence
  Synthetic oligonucleotide
ccgttggtgggacacccctgatcttgcctcttattga

SEQ ID NO: 3468 - DNA, 35 bp, Artificial Sequence
  Synthetic oligonucleotide
acccgatagctttgaggtttgtttttctgtgcctt

SEQ ID NO: 3469 - DNA, 36 bp, Artificial Sequence
  Synthetic oligonucleotide
tctagcgtttgcttaccgcacactttctgtgaaaaa

SEQ ID NO: 3470 - DNA, 38 bp, Artificial Sequence
  Synthetic oligonucleotide
gagctttagaggcgcttgagggcgactttcctgtttga

SEQ ID NO: 3471 - DNA, 35 bp, Artificial Sequence
  Synthetic oligonucleotide
aatagaatgatttgtccggtcccgtatttcttgct

SEQ ID NO: 3472 - DNA, 37 bp, Artificial Sequence
  Synthetic oligonucleotide
ttcgtaacgttgaccgtgttgtttcgtttatgcctga

SEQ ID NO: 3473 - DNA, 38 bp, Artificial Sequence
  Synthetic oligonucleotide
agacccgtgaggatacatttttgtttaatttggcttga

SEQ ID NO: 3474 - DNA, 37 bp, Artificial Sequence
  Synthetic oligonucleotide
ttaacgcccaagctcggggaccgtgttctgtttttga

SEQ ID NO: 3475 - DNA, 38 bp, Artificial Sequence
  Synthetic oligonucleotide
gcatggttttgttcgaatatttccgaatcacgatttga

SEQ ID NO: 3476 - DNA, 37 bp, Artificial Sequence
  Synthetic oligonucleotide
ttgcaaatggaacctatgccctgttttaatgacttga

SEQ ID NO: 3477 - DNA, 37 bp, Artificial Sequence
  Synthetic oligonucleotide
attttatcggttttgtacctgatttgctttgattgga

SEQ ID NO: 3478 - DNA, 35 bp, Artificial Sequence
  Synthetic oligonucleotide
agtggacgcgttacctcacttttgcttgaatttgc

SEQ ID NO: 3479 - DNA, 35 bp, Artificial Sequence
  Synthetic oligonucleotide
atgtttgttgttgttcctccccttatgacttaatc

SEQ ID NO: 3480 - DNA, 38 bp, Artificial Sequence
  Synthetic oligonucleotide
tttgcctgtgaggtaaatctcatagtatccgtttttga

SEQ ID NO: 3481 - DNA, 35 bp, Artificial Sequence
  Synthetic oligonucleotide
ttttgcttcgtgtggtggttaactttcgcgcttac

SEQ ID NO: 3482 - DNA, 35 bp, Artificial Sequence
  Synthetic oligonucleotide
tgatcaatctggtccctcttttttggagtcttcac

SEQ ID NO: 3483 - DNA, 37 bp, Artificial Sequence
  Synthetic oligonucleotide
ttagcattcgccttccaaacccacgggtttgccttga

SEQ ID NO: 3484 - DNA, 37 bp, Artificial Sequence
  Synthetic oligonucleotide
acacggttgtccctggattagctctttgatttggtga

SEQ ID NO: 3485 - DNA, 37 bp, Artificial Sequence
  Synthetic oligonucleotide
ttcactcgaggtttcggttttataaatttctgtacga

SEQ ID NO: 3486 - DNA, 38 bp, Artificial Sequence
  Synthetic oligonucleotide
cccaacttggtttctgtttatgatctattcggtgatga

SEQ ID NO: 3487 - DNA, 36 bp, Artificial Sequence
  Synthetic oligonucleotide
attgcccttgtttggtgtgtgtatttttctcatgta

SEQ ID NO: 3488 - DNA, 37 bp, Artificial Sequence
  Synthetic oligonucleotide
actttctgggtttacttctggtggtttccatgtatga

SEQ ID NO: 3489 - DNA, 35 bp, Artificial Sequence
  Synthetic oligonucleotide
ttttgaccctgcgaaccgaatgaccgtaatcgtta

SEQ ID NO: 3490 - DNA, 38 bp, Artificial Sequence
  Synthetic oligonucleotide
gattcttcaactcgggttgacacctgttcgccttttga

SEQ ID NO: 3491 - DNA, 38 bp, Artificial Sequence
  Synthetic oligonucleotide
ggtggtcctttgttgacggaatttatttggttctctga

SEQ ID NO: 3492 - DNA, 37 bp, Artificial Sequence
  Synthetic oligonucleotide
tatttcttccgtgttttccatactgtgatgatggaga

SEQ ID NO: 3493 - DNA, 35 bp, Artificial Sequence
  Synthetic oligonucleotide
tttggctctttagcacacgggtttctagttccgtt

SEQ ID NO: 3494 - DNA, 38 bp, Artificial Sequence
  Synthetic oligonucleotide
ggaagtactgtactccgaatcggatcggatttttttga

SEQ ID NO: 3495 - DNA, 35 bp, Artificial Sequence
  Synthetic oligonucleotide
aataggaacttgccctcgcttttaattgttgcctt

SEQ ID NO: 3496 - DNA, 38 bp, Artificial Sequence
  Synthetic oligonucleotide
ttttctgacttttggggtggtctaaatatacttggtga

SEQ ID NO: 3497 - DNA, 35 bp, Artificial Sequence
  Synthetic oligonucleotide
aatttgcctcgtttttccgggtcctgaagggatct

SEQ ID NO: 3498 - DNA, 35 bp, Artificial Sequence
  Synthetic oligonucleotide
tcgacttaatgtcttattcggagccctacttgaaa

SEQ ID NO: 3499 - DNA, 38 bp, Artificial Sequence
  Synthetic oligonucleotide
gccgctaacgctgaaccgacgttgttaaatccgtgtga

SEQ ID NO: 3500 - DNA, 38 bp, Artificial Sequence
  Synthetic oligonucleotide
ttccttgatggggttcgcctttttctgccaactattga

SEQ ID NO: 3501 - DNA, 35 bp, Artificial Sequence
  Synthetic oligonucleotide
gcaccgaagagtacgtttcgaccttggattattgc

SEQ ID NO: 3502 - DNA, 35 bp, Artificial Sequence
  Synthetic oligonucleotide
tactgtcctattccccgtagttttttgtacctgga

SEQ ID NO: 3503 - DNA, 38 bp, Artificial Sequence
  Synthetic oligonucleotide
ttgcgaacttggttagcccgcctagagggttgatttga

SEQ ID NO: 3504 - DNA, 36 bp, Artificial Sequence
  Synthetic oligonucleotide
gaatgtcaccttgtggtagtgggtttctggttttga

SEQ ID NO: 3505 - DNA, 37 bp, Artificial Sequence
  Synthetic oligonucleotide
tgaaccacttagatccgttccttaaccctgcttatga

SEQ ID NO: 3506 - DNA, 35 bp, Artificial Sequence
  Synthetic oligonucleotide
ttaatcccctttcttctcgcttatgaagaaactta

SEQ ID NO: 3507 - DNA, 37 bp, Artificial Sequence
  Synthetic oligonucleotide
gagtgcgggttgatcacttggtggggtatcttcttga

SEQ ID NO: 3508 - DNA, 35 bp, Artificial Sequence
  Synthetic oligonucleotide
tcaacacgctgaccatatgttacttgtgccctgct

SEQ ID NO: 3509 - DNA, 36 bp, Artificial Sequence
  Synthetic oligonucleotide
aattctctcagtttcgctcgtagcgagtttttgcca

SEQ ID NO: 3510 - DNA, 38 bp, Artificial Sequence
  Synthetic oligonucleotide
aagttctttgccctttctttgctacctgaataatatga

SEQ ID NO: 3511 - DNA, 38 bp, Artificial Sequence
  Synthetic oligonucleotide
tgcagtatggacacagtgggtattttgttgtttggtga

SEQ ID NO: 3512 - DNA, 38 bp, Artificial Sequence
  Synthetic oligonucleotide
ttggagctgtactcccgctttatatctgtatctcgtga

SEQ ID NO: 3513 - DNA, 35 bp, Artificial Sequence
  Synthetic oligonucleotide
actttaacgaaactttgccgtatttcgtttgattc

SEQ ID NO: 3514 - DNA, 38 bp, Artificial Sequence
  Synthetic oligonucleotide
acattgtaaatcccaattctgatggtttgtttgtttga

SEQ ID NO: 3515 - DNA, 38 bp, Artificial Sequence
  Synthetic oligonucleotide
atccggtttgatcttcggagatgatatgaaatttgtga

SEQ ID NO: 3516 - DNA, 35 bp, Artificial Sequence
  Synthetic oligonucleotide
acggcgtgagccatggaaaagtaaattttgcccga

SEQ ID NO: 3517 - DNA, 35 bp, Artificial Sequence
  Synthetic oligonucleotide
atccaaaacataacctttgccgggggtattctctt

SEQ ID NO: 3518 - DNA, 38 bp, Artificial Sequence
  Synthetic oligonucleotide
ttgctcggtcaaatattgttcgttgtttcaacccgtga

SEQ ID NO: 3519 - DNA, 38 bp, Artificial Sequence
  Synthetic oligonucleotide
attgcatatccgttttctcaactgtaccgcttgggtga

SEQ ID NO: 3520 - DNA, 35 bp, Artificial Sequence
  Synthetic oligonucleotide
acctggaccggtgtcgaaccggaaatctgccctct

SEQ ID NO: 3521 - DNA, 38 bp, Artificial Sequence
  Synthetic oligonucleotide
catgcagtgggtaactaaacgcttctgtatactggtga

SEQ ID NO: 3522 - DNA, 35 bp, Artificial Sequence
  Synthetic oligonucleotide
tcatgaagcttggcttctgaaatccacacgatttt

SEQ ID NO: 3523 - DNA, 35 bp, Artificial Sequence
  Synthetic oligonucleotide
gcacccggttttgtttaactgcttgtaggaccacc

SEQ ID NO: 3524 - DNA, 35 bp, Artificial Sequence
  Synthetic oligonucleotide
ttttcgccgtgaggaataccgttgggtcctttgtt

SEQ ID NO: 3525 - DNA, 38 bp, Artificial Sequence
  Synthetic oligonucleotide
tcgttaaattgggcttgcctgtgccttttttcccgtga

SEQ ID NO: 3526 - DNA, 38 bp, Artificial Sequence
  Synthetic oligonucleotide
attgggggtcaccttgggtttggatgttttttgtttga

SEQ ID NO: 3527 - DNA, 37 bp, Artificial Sequence
  Synthetic oligonucleotide
ttgacgaaattacccggtattgtgcttataaattgga

SEQ ID NO: 3528 - DNA, 37 bp, Artificial Sequence
  Synthetic oligonucleotide
tgcgattgattccttccgtgccgttttgaaactatga

SEQ ID NO: 3529 - DNA, 36 bp, Artificial Sequence
  Synthetic oligonucleotide
tctgtgccaataactctaaatgccgcttagtttgaa

SEQ ID NO: 3530 - DNA, 38 bp, Artificial Sequence
  Synthetic oligonucleotide
atggtgatcggtggtttgttactctgtccgtttcttga

SEQ ID NO: 3531 - DNA, 35 bp, Artificial Sequence
  Synthetic oligonucleotide
gcccggttacgtaccttggggtgtttgtctcttgc

SEQ ID NO: 3532 - DNA, 35 bp, Artificial Sequence
  Synthetic oligonucleotide
tgcgagtcctctgaatctgatcctaaacttcttgc

SEQ ID NO: 3533 - DNA, 38 bp, Artificial Sequence
  Synthetic oligonucleotide
actccggccttcttctgtatcggtttttttgctgttga

SEQ ID NO: 3534 - DNA, 35 bp, Artificial Sequence
  Synthetic oligonucleotide
tcgactcttgtgccatggtttccttatctggtatt

SEQ ID NO: 3535 - DNA, 36 bp, Artificial Sequence
  Synthetic oligonucleotide
ttcgatctgtgcgaacagattttgttttgccctgga

SEQ ID NO: 3536 - DNA, 35 bp, Artificial Sequence
  Synthetic oligonucleotide
ttcgtcgtttaaacacatttgtccgctatgcctta

SEQ ID NO: 3537 - DNA, 37 bp, Artificial Sequence
  Synthetic oligonucleotide
atggaaggggttccatttcctttatttgggttttcga

SEQ ID NO: 3538 - DNA, 37 bp, Artificial Sequence
  Synthetic oligonucleotide
tgcttgggtgcaatgcgaacgcatattaatttgttga

SEQ ID NO: 3539 - DNA, 35 bp, Artificial Sequence
  Synthetic oligonucleotide
gcattgtgtaacttcggtttttttggaattttcgc

SEQ ID NO: 3540 - DNA, 36 bp, Artificial Sequence
  Synthetic oligonucleotide
gggtccaaacggcttggccattttctctatttctga

SEQ ID NO: 3541 - DNA, 38 bp, Artificial Sequence
  Synthetic oligonucleotide
gataatcttgctccgtagaaacatacttactctggtga

SEQ ID NO: 3542 - DNA, 35 bp, Artificial Sequence
  Synthetic oligonucleotide
atcgagtgtctcccgttttatctttgattgtttgc

SEQ ID NO: 3543 - DNA, 36 bp, Artificial Sequence
  Synthetic oligonucleotide
tctctgtattcgtttttctgatatttggttgtagaa

SEQ ID NO: 3544 - DNA, 36 bp, Artificial Sequence
  Synthetic oligonucleotide
tctcctgggtcccgttcggttatattatgcttgtga

SEQ ID NO: 3545 - DNA, 38 bp, Artificial Sequence
  Synthetic oligonucleotide
accgctcccttttgttcgggcttggccaatttccttga

SEQ ID NO: 3546 - DNA, 35 bp, Artificial Sequence
  Synthetic oligonucleotide
aggccaattttatagcggtgactcacttttgccct

SEQ ID NO: 3547 - DNA, 38 bp, Artificial Sequence
  Synthetic oligonucleotide
gggtgaggtaccttctccgtgtgattctccgtttttga

SEQ ID NO: 3548 - DNA, 38 bp, Artificial Sequence
  Synthetic oligonucleotide
gaaacgtgattataccgacttgttgcttacgaatttga

SEQ ID NO: 3549 - DNA, 36 bp, Artificial Sequence
  Synthetic oligonucleotide
ttgcctgagagatgccgctttgttcttcgtaatcta

SEQ ID NO: 3550 - DNA, 38 bp, Artificial Sequence
  Synthetic oligonucleotide
ttctctgacccggtttttttacatatgtgacgttttga

SEQ ID NO: 3551 - DNA, 38 bp, Artificial Sequence
  Synthetic oligonucleotide
tgcacctcgtaaaaaaactcgggtctggaatttcgtga

SEQ ID NO: 3552 - DNA, 38 bp, Artificial Sequence
  Synthetic oligonucleotide
cataaactctccttcctgcactcttccggattacttga

SEQ ID NO: 3553 - DNA, 35 bp, Artificial Sequence
  Synthetic oligonucleotide
acccgggtttgcatactgttcttctgtccttatga

SEQ ID NO: 3554 - DNA, 38 bp, Artificial Sequence
  Synthetic oligonucleotide
tctgaaactagcatgagccttactgacctgatgtttga

SEQ ID NO: 3555 - DNA, 35 bp, Artificial Sequence
  Synthetic oligonucleotide
tattgcccgccactttctgaatgatttgatctgct

SEQ ID NO: 3556 - DNA, 37 bp, Artificial Sequence
  Synthetic oligonucleotide
gacgcaccaaattatgcaatacaaattctgcccttga

SEQ ID NO: 3557 - DNA, 35 bp, Artificial Sequence
  Synthetic oligonucleotide
gggttacgttattctccggtaccttgggtttaaaa

SEQ ID NO: 3558 - DNA, 35 bp, Artificial Sequence
  Synthetic oligonucleotide
gacaactcccgtgaggagtttctgattttatgttt

SEQ ID NO: 3559 - DNA, 38 bp, Artificial Sequence
  Synthetic oligonucleotide
ttactagccggtggatctgcccacgttcgtttttttga

SEQ ID NO: 3560 - DNA, 38 bp, Artificial Sequence
  Synthetic oligonucleotide
gcacaaattgcccggtataattgttatacgctatgtga

SEQ ID NO: 3561 - DNA, 37 bp, Artificial Sequence
  Synthetic oligonucleotide
taccgaggtcgagggatttttgtttgtccttatgtga

SEQ ID NO: 3562 - DNA, 36 bp, Artificial Sequence
  Synthetic oligonucleotide
aaaattgccggcgccgtagccttgttttcatcttta

SEQ ID NO: 3563 - DNA, 38 bp, Artificial Sequence
  Synthetic oligonucleotide
tccgcgggccgtaatttggttagattttctgtttgtga

SEQ ID NO: 3564 - DNA, 37 bp, Artificial Sequence
  Synthetic oligonucleotide
ttgcctcgctttgaccagtgttcctgtttctccttga

SEQ ID NO: 3565 - DNA, 38 bp, Artificial Sequence
  Synthetic oligonucleotide
gggcggaccgcctggggttttgaaccttacaatcttga

SEQ ID NO: 3566 - DNA, 38 bp, Artificial Sequence
  Synthetic oligonucleotide
gagtacgtgaccggtgaaaaatattgggatgtgtgtga

SEQ ID NO: 3567 - DNA, 37 bp, Artificial Sequence
  Synthetic oligonucleotide
tttgcgcgtgagcgttataaaattttccgactaccga

SEQ ID NO: 3568 - DNA, 38 bp, Artificial Sequence
  Synthetic oligonucleotide
ggtcgccttgccacaccgataatcgttgaattttgtga

SEQ ID NO: 3569 - DNA, 35 bp, Artificial Sequence
  Synthetic oligonucleotide
tgccgctggacactatatatggtttctgaaatgcc

SEQ ID NO: 3570 - DNA, 38 bp, Artificial Sequence
  Synthetic oligonucleotide
gagaacgcacaagttgccacgaggtttatttgccttga

SEQ ID NO: 3571 - DNA, 37 bp, Artificial Sequence
  Synthetic oligonucleotide
tgccctgtaaaacctcggacggtttcctgtttgttga

SEQ ID NO: 3572 - DNA, 35 bp, Artificial Sequence
  Synthetic oligonucleotide
tccatctaagattatctcgtatcacactattaaat

SEQ ID NO: 3573 - DNA, 37 bp, Artificial Sequence
  Synthetic oligonucleotide
tatcaacccaaactaaccgctcaataatgaattaaga

SEQ ID NO: 3574 - DNA, 36 bp, Artificial Sequence
  Synthetic oligonucleotide
agtcagtactaaactctctaaacatctggatccaaa

SEQ ID NO: 3575 - DNA, 36 bp, Artificial Sequence
  Synthetic oligonucleotide
ttcgcaagtccaggatcgcgactaaataccttacaa

SEQ ID NO: 3576 - DNA, 36 bp, Artificial Sequence
  Synthetic oligonucleotide
tgcctcatcccgaatagttttgtcaacccatccaca

SEQ ID NO: 3577 - DNA, 37 bp, Artificial Sequence
  Synthetic oligonucleotide
acactctaccaaatagccactcgcaaacatataaaga

SEQ ID NO: 3578 - DNA, 36 bp, Artificial Sequence
  Synthetic oligonucleotide
tcgtcactcactcaatatccttggtacctactcaaa

SEQ ID NO: 3579 - DNA, 36 bp, Artificial Sequence
  Synthetic oligonucleotide
tgcaggcccctgtgaacacctttattgaatagcaca

SEQ ID NO: 3580 - DNA, 35 bp, Artificial Sequence
  Synthetic oligonucleotide
gcactgtgacctaccactttgacctctgtttaaac

SEQ ID NO: 3581 - DNA, 36 bp, Artificial Sequence
  Synthetic oligonucleotide
acctcgaccatctacaaactttgaagccacaccaaa

SEQ ID NO: 3582 - DNA, 36 bp, Artificial Sequence
  Synthetic oligonucleotide
taagcctgactccatcgtctattattttttttaagc

SEQ ID NO: 3583 - DNA, 35 bp, Artificial Sequence
  Synthetic oligonucleotide
atcgccacgaccaaccaccacggatcccacataaa

SEQ ID NO: 3584 - DNA, 36 bp, Artificial Sequence
  Synthetic oligonucleotide
tactcgacgaaatagctaacaacggacccgataaaa

SEQ ID NO: 3585 - DNA, 37 bp, Artificial Sequence
  Synthetic oligonucleotide
aaatcatccgtagtttatcctttgtctccatccaaga

SEQ ID NO: 3586 - DNA, 35 bp, Artificial Sequence
  Synthetic oligonucleotide
gggaacgtaactcaggtttttttcatcccaacaca

SEQ ID NO: 3587 - DNA, 38 bp, Artificial Sequence
  Synthetic oligonucleotide
aactcggccacccgtagacgtatatccaattcacttga

SEQ ID NO: 3588 - DNA, 37 bp, Artificial Sequence
  Synthetic oligonucleotide
ctgcagcttgatcttcgtcacaacacatctattacga

SEQ ID NO: 3589 - DNA, 38 bp, Artificial Sequence
  Synthetic oligonucleotide
ccttccaatctgcatcgctaacgcatacaccattatga

SEQ ID NO: 3590 - DNA, 38 bp, Artificial Sequence
  Synthetic oligonucleotide
gatctattcaccttagccataattatagaccccaatga

SEQ ID NO: 3591 - DNA, 35 bp, Artificial Sequence
  Synthetic oligonucleotide
ccgtactgtttacacatatctatccacgtattaca

SEQ ID NO: 3592 - DNA, 35 bp, Artificial Sequence
  Synthetic oligonucleotide
acgtctgccaaatctactcgcattcgatacacacc

SEQ ID NO: 3593 - DNA, 35 bp, Artificial Sequence
  Synthetic oligonucleotide
ctgtcgacattccgctataaaattaccaacccaat

SEQ ID NO: 3594 - DNA, 36 bp, Artificial Sequence
  Synthetic oligonucleotide
gagtacgcaattattatccgaagtcaactatagcaa

SEQ ID NO: 3595 - DNA, 36 bp, Artificial Sequence
  Synthetic oligonucleotide
gagtaactagtcatcaattctatcttcgcacactaa

SEQ ID NO: 3596 - DNA, 35 bp, Artificial Sequence
  Synthetic oligonucleotide
atgcgctactgcctagctcccgctcgcccatataa

SEQ ID NO: 3597 - DNA, 36 bp, Artificial Sequence
  Synthetic oligonucleotide
acaatatcgatctccaaaactatctcgtgtatctca

SEQ ID NO: 3598 - DNA, 38 bp, Artificial Sequence
  Synthetic oligonucleotide
acgtacccgaccccggcgttaagccgtctttgtactga

SEQ ID NO: 3599 - DNA, 35 bp, Artificial Sequence
  Synthetic oligonucleotide
gtcactcattatatggttctacactacgatcatca

SEQ ID NO: 3600 - DNA, 36 bp, Artificial Sequence
  Synthetic oligonucleotide
gactccgtcgttcatttcactaacacgtatgccaga

SEQ ID NO: 3601 - DNA, 36 bp, Artificial Sequence
  Synthetic oligonucleotide
tagtacccacttattactatcggagttcaaacataa

SEQ ID NO: 3602 - DNA, 36 bp, Artificial Sequence
  Synthetic oligonucleotide
tcgagcgcacagattcgttttccaccgcgaacttca

SEQ ID NO: 3603 - DNA, 37 bp, Artificial Sequence
  Synthetic oligonucleotide
gccacgtttcctactttcgttcgttcgccacgtagga

SEQ ID NO: 3604 - DNA, 35 bp, Artificial Sequence
  Synthetic oligonucleotide
tcactgacccacctctcgatccccaattaaatatt

SEQ ID NO: 3605 - DNA, 36 bp, Artificial Sequence
  Synthetic oligonucleotide
cgcttcccgaatcgagagatcaagcgatcagccgta

SEQ ID NO: 3606 - DNA, 37 bp, Artificial Sequence
  Synthetic oligonucleotide
tcttacgtacgcttcgtagacaattattcatttctga

SEQ ID NO: 3607 - DNA, 38 bp, Artificial Sequence
  Synthetic oligonucleotide
tgctacacgaaacctgtactgctagctatctatcatga

SEQ ID NO: 3608 - DNA, 36 bp, Artificial Sequence
  Synthetic oligonucleotide
ctagctcttcagtcgcactcctagtctcaccattca

SEQ ID NO: 3609 - DNA, 35 bp, Artificial Sequence
  Synthetic oligonucleotide
tgaccattagttaactctatcttttgaaataatct

SEQ ID NO: 3610 - DNA, 36 bp, Artificial Sequence
  Synthetic oligonucleotide
agcctcataggcattccggtgtcacgcaaacacata

SEQ ID NO: 3611 - DNA, 38 bp, Artificial Sequence
  Synthetic oligonucleotide
tgccgtcccgggactcaatccacgtttttattttctca

SEQ ID NO: 3612 - DNA, 38 bp, Artificial Sequence
  Synthetic oligonucleotide
tgccgctaaggcagttactacagggtcttattacatga

SEQ ID NO: 3613 - DNA, 35 bp, Artificial Sequence
  Synthetic oligonucleotide
gaccccttgttaaatgtatccttgttaattacgat

SEQ ID NO: 3614 - DNA, 36 bp, Artificial Sequence
  Synthetic oligonucleotide
caaccgtcctctaatttcacgcctgtcggtcattca

SEQ ID NO: 3615 - DNA, 38 bp, Artificial Sequence
  Synthetic oligonucleotide
ctacaccactattcaaaacgaatatctcatcatactga

SEQ ID NO: 3616 - DNA, 36 bp, Artificial Sequence
  Synthetic oligonucleotide
ttgtacctgcactgcctcaagttattacatctcata

SEQ ID NO: 3617 - DNA, 38 bp, Artificial Sequence
  Synthetic oligonucleotide
taggcgagagcctttgacaggttaccaggtggtggtga

SEQ ID NO: 3618 - DNA, 37 bp, Artificial Sequence
  Synthetic oligonucleotide
agtgactgcgcaaatcactacaacttccatccaaaga

SEQ ID NO: 3619 - DNA, 37 bp, Artificial Sequence
  Synthetic oligonucleotide
gagtgactgctttgacctatacacacaaccaacttaa

SEQ ID NO: 3620 - DNA, 36 bp, Artificial Sequence
  Synthetic oligonucleotide
atttaaccctaaatatttcaacacacaaacaccaca

SEQ ID NO: 3621 - DNA, 38 bp, Artificial Sequence
  Synthetic oligonucleotide
ctctggactgcaacacagtgccgttccgaccttcttga

SEQ ID NO: 3622 - DNA, 36 bp, Artificial Sequence
  Synthetic oligonucleotide
tacttagtcttcttcggatcgcgaccgtggtcggta

SEQ ID NO: 3623 - DNA, 35 bp, Artificial Sequence
  Synthetic oligonucleotide
atatcgtacctattttctaatcttacgctgttcac

SEQ ID NO: 3624 - DNA, 38 bp, Artificial Sequence
  Synthetic oligonucleotide
cccccgcaccacattattccgatcatattatccattga

SEQ ID NO: 3625 - DNA, 35 bp, Artificial Sequence
  Synthetic oligonucleotide
acttaatattccattctcaattacactattcggtt

SEQ ID NO: 3626 - DNA, 38 bp, Artificial Sequence
  Synthetic oligonucleotide
ttcgtcactgctacttttatattaagcccatagaatga

SEQ ID NO: 3627 - DNA, 36 bp, Artificial Sequence
  Synthetic oligonucleotide
cctcgcatccgacttttacaatcacataatcacgta

SEQ ID NO: 3628 - DNA, 36 bp, Artificial Sequence
  Synthetic oligonucleotide
ttgaaagcccctcaatggccacctattttgcattca

SEQ ID NO: 3629 - DNA, 36 bp, Artificial Sequence
  Synthetic oligonucleotide
gagtactgtctctattccacaagcataactacttca

SEQ ID NO: 3630 - DNA, 38 bp, Artificial Sequence
  Synthetic oligonucleotide
aggcgactgccgcagtgccgctgtccgtttcatcatga

SEQ ID NO: 3631 - DNA, 38 bp, Artificial Sequence
  Synthetic oligonucleotide
aatgccaagtcttatcgctagcaataatattgaactga

SEQ ID NO: 3632 - DNA, 36 bp, Artificial Sequence
  Synthetic oligonucleotide
atcccctgtctgcatgcaggcctatgaccgcactca

SEQ ID NO: 3633 - DNA, 37 bp, Artificial Sequence
  Synthetic oligonucleotide
gggggcgggagctacgcaagcatgcctttgacattga

SEQ ID NO: 3634 - DNA, 38 bp, Artificial Sequence
  Synthetic oligonucleotide
taatttctctgcatctatctcaaagcaccactatctta

SEQ ID NO: 3635 - DNA, 36 bp, Artificial Sequence
  Synthetic oligonucleotide
acccatctaccgcattattaacgttataaccctaaa

SEQ ID NO: 3636 - DNA, 37 bp, Artificial Sequence
  Synthetic oligonucleotide
cctgcctatcgccccttcatattctcagatcagcaga

SEQ ID NO: 3637 - DNA, 36 bp, Artificial Sequence
  Synthetic oligonucleotide
ttctcgtctcggggctaatacacatacaattataca

SEQ ID NO: 3638 - DNA, 35 bp, Artificial Sequence
  Synthetic oligonucleotide
gctcattctattttagcatatcatccatctaatcg

SEQ ID NO: 3639 - DNA, 35 bp, Artificial Sequence
  Synthetic oligonucleotide
aatccgtcatgtattaaacacttctatcacattcg

SEQ ID NO: 3640 - DNA, 37 bp, Artificial Sequence
  Synthetic oligonucleotide
actcttctgaatcgaaaccaatctcactttcagggga

SEQ ID NO: 3641 - DNA, 36 bp, Artificial Sequence
  Synthetic oligonucleotide
ctaccatcacatcctatcatcgcatttagtcttgta

SEQ ID NO: 3642 - DNA, 35 bp, Artificial Sequence
  Synthetic oligonucleotide
ctaatcatctcttcaaattcaacggcgaacaaaac

SEQ ID NO: 3643 - DNA, 38 bp, Artificial Sequence
  Synthetic oligonucleotide
taagcacttccgttttaatctttacgacgcacccatga

SEQ ID NO: 3644 - DNA, 36 bp, Artificial Sequence
  Synthetic oligonucleotide
tactatcggcacttctacggaggataccctcgatta

SEQ ID NO: 3645 - DNA, 35 bp, Artificial Sequence
  Synthetic oligonucleotide
tgagctgccgctatggtgaccttctatcccattat

SEQ ID NO: 3646 - DNA, 36 bp, Artificial Sequence
  Synthetic oligonucleotide
ccttacagacggtcaccgtcttgcgggttattacaa

SEQ ID NO: 3647 - DNA, 36 bp, Artificial Sequence
  Synthetic oligonucleotide
ccagtcagtctgttactgtcttgttcccatccctca

SEQ ID NO: 3648 - DNA, 36 bp, Artificial Sequence
  Synthetic oligonucleotide
cgtttccacacgccgattcaaatccctcattaacca

SEQ ID NO: 3649 - DNA, 35 bp, Artificial Sequence
  Synthetic oligonucleotide
acctaacatcctatcaccgcttatgtattgcatca

SEQ ID NO: 3650 - DNA, 35 bp, Artificial Sequence
  Synthetic oligonucleotide
gcagtaggttgtgatgctagctaattatactatac

SEQ ID NO: 3651 - DNA, 38 bp, Artificial Sequence
  Synthetic oligonucleotide
cccgccgcacgtccaatattcaaccatgaccttactga

SEQ ID NO: 3652 - DNA, 35 bp, Artificial Sequence
  Synthetic oligonucleotide
atcgccatcatcgctttatctggtcgtgggaaccc

SEQ ID NO: 3653 - DNA, 36 bp, Artificial Sequence
  Synthetic oligonucleotide
tgtcatccgttatttcattcaccttctactatgtaa

SEQ ID NO: 3654 - DNA, 37 bp, Artificial Sequence
  Synthetic oligonucleotide
tactattatcatccacgccatcagccgggtcttcgga

SEQ ID NO: 3655 - DNA, 38 bp, Artificial Sequence
  Synthetic oligonucleotide
ccttacatacatactccgcatacgtgcctatttaatga

SEQ ID NO: 3656 - DNA, 37 bp, Artificial Sequence
  Synthetic oligonucleotide
acaactatcaaataaacctgcgccctctattaatgga

SEQ ID NO: 3657 - DNA, 35 bp, Artificial Sequence
  Synthetic oligonucleotide
gcaccatcgccggactgctcatatccccgttgtaa

SEQ ID NO: 3658 - DNA, 37 bp, Artificial Sequence
  Synthetic oligonucleotide
ctcgcagtaatggtgcccacatgttacgtctctttga

SEQ ID NO: 3659 - DNA, 36 bp, Artificial Sequence
  Synthetic oligonucleotide
ttagtactgtcattcgaggattcgaatctagcttta

SEQ ID NO: 3660 - DNA, 36 bp, Artificial Sequence
  Synthetic oligonucleotide
tgtaaacgtacgatattacttccgatccatacatca

SEQ ID NO: 3661 - DNA, 37 bp, Artificial Sequence
  Synthetic oligonucleotide
attcaagcaatctagtaattattctttcactgccgga

SEQ ID NO: 3662 - DNA, 38 bp, Artificial Sequence
  Synthetic oligonucleotide
taccatctctattccacgtccacgacacgctgccatga

SEQ ID NO: 3663 - DNA, 36 bp, Artificial Sequence
  Synthetic oligonucleotide
tgttgacaatgccgctgtcccgtctacccttcgata

SEQ ID NO: 3664 - DNA, 35 bp, Artificial Sequence
  Synthetic oligonucleotide
catgtcgccgtcgcgcacagcctacatcccactta

SEQ ID NO: 3665 - DNA, 35 bp, Artificial Sequence
  Synthetic oligonucleotide
gagtacttctcataaacgaaatatcaaattcgaat

SEQ ID NO: 3666 - DNA, 38 bp, Artificial Sequence
  Synthetic oligonucleotide
tgactgcgaaactaacgtatccccatatatacaattga

SEQ ID NO: 3667 - DNA, 36 bp, Artificial Sequence
  Synthetic oligonucleotide
ttcagcgcgttcttcacagcggggtagcactcatca

SEQ ID NO: 3668 - DNA, 35 bp, Artificial Sequence
  Synthetic oligonucleotide
tcagtacatcattaatcaccatatcacgcattatc

SEQ ID NO: 3669 - DNA, 36 bp, Artificial Sequence
  Synthetic oligonucleotide
agtctactgcatcatctcccttactccaagtagtaa

SEQ ID NO: 3670 - DNA, 36 bp, Artificial Sequence
  Synthetic oligonucleotide
gctcatactcagcactgcgaattgccagtccttcac

SEQ ID NO: 3671 - DNA, 38 bp, Artificial Sequence
  Synthetic oligonucleotide
gctgcatctcgtcactccaggtggttggtacattgtga

SEQ ID NO: 3672 - DNA, 35 bp, Artificial Sequence
  Synthetic oligonucleotide
gttagctagaacgaacgcacgtcttctatctttta

SEQ ID NO: 3673 - DNA, 36 bp, Artificial Sequence
  Synthetic oligonucleotide
ttcgttattgccttagttacactctattataggtta

SEQ ID NO: 3674 - DNA, 37 bp, Artificial Sequence
  Synthetic oligonucleotide
tatcggacacttactacattaccgtcgcttataccga

SEQ ID NO: 3675 - DNA, 38 bp, Artificial Sequence
  Synthetic oligonucleotide
atcaacgtactcgaacgcgtccacaccccaccatctga

SEQ ID NO: 3676 - DNA, 38 bp, Artificial Sequence
  Synthetic oligonucleotide
gagctactctgaatctcattgatatctacaataaatga

SEQ ID NO: 3677 - DNA, 36 bp, Artificial Sequence
  Synthetic oligonucleotide
taataggacggcgggctcttgccgatatttcctgta

SEQ ID NO: 3678 - DNA, 35 bp, Artificial Sequence
  Synthetic oligonucleotide
catcttatacagctcagcctctattcccatacgtc

SEQ ID NO: 3679 - DNA, 36 bp, Artificial Sequence
  Synthetic oligonucleotide
ctgccggatcttgcacgcactgctattatatttcca

SEQ ID NO: 3680 - DNA, 35 bp, Artificial Sequence
  Synthetic oligonucleotide
actgcctaaggctatcgcatcaatatgaactcaac

SEQ ID NO: 3681 - DNA, 37 bp, Artificial Sequence
  Synthetic oligonucleotide
ctactgcacgacgcgagtccttatcaatatctcacga

SEQ ID NO: 3682 - DNA, 35 bp, Artificial Sequence
  Synthetic oligonucleotide
gagtacttacgtaacgagttattaatgtccaaaat

SEQ ID NO: 3683 - DNA, 36 bp, Artificial Sequence
  Synthetic oligonucleotide
aaggactcaatgccactatacgacttattccaatca

SEQ ID NO: 3684 - DNA, 35 bp, Artificial Sequence
  Synthetic oligonucleotide
cttttctagctagcatttacacttttatacacaac

SEQ ID NO: 3685 - DNA, 37 bp, Artificial Sequence
  Synthetic oligonucleotide
tcgggttctccctctcgccacctaggtttaaaacgga

SEQ ID NO: 3686 - DNA, 38 bp, Artificial Sequence
  Synthetic oligonucleotide
cgcatgcactgaacatatacacatctcgtcgctcctga

SEQ ID NO: 3687 - DNA, 36 bp, Artificial Sequence
  Synthetic oligonucleotide
ttacctctctacaccatttaccaacggctacgccga

SEQ ID NO: 3688 - DNA, 38 bp, Artificial Sequence
  Synthetic oligonucleotide
gacgtcttctttcacagcatgccgtaacagttttctga

SEQ ID NO: 3689 - DNA, 35 bp, Artificial Sequence
  Synthetic oligonucleotide
ctacagactaactagttcccgaattctgccacaac

SEQ ID NO: 3690 - DNA, 37 bp, Artificial Sequence
  Synthetic oligonucleotide
aatccacgtgcccaacataaagatctaactcacaaga

SEQ ID NO: 3691 - DNA, 36 bp, Artificial Sequence
  Synthetic oligonucleotide
tacgacgcctctgttaatccgtttttatataccaca

SEQ ID NO: 3692 - DNA, 38 bp, Artificial Sequence
  Synthetic oligonucleotide
ggcgggaatcacgccaaacctctgtcacctatcgctga

SEQ ID NO: 3693 - DNA, 38 bp, Artificial Sequence
  Synthetic oligonucleotide
cttctgccacttcatctcgtcaaggttcatttcgttga

SEQ ID NO: 3694 - DNA, 36 bp, Artificial Sequence
  Synthetic oligonucleotide
cgcacaacgtaccggtccagggaacacattttcgca

SEQ ID NO: 3695 - DNA, 38 bp, Artificial Sequence
  Synthetic oligonucleotide
ctctcaccagcacgtcccacacattttcacaaacctga

SEQ ID NO: 3696 - DNA, 38 bp, Artificial Sequence
  Synthetic oligonucleotide
tttctcgcgcggcaggcatccgttctaatataccatga

SEQ ID NO: 3697 - DNA, 36 bp, Artificial Sequence
  Synthetic oligonucleotide
accacaacttatcgcatctcattgattggactaata

SEQ ID NO: 3698 - DNA, 35 bp, Artificial Sequence
  Synthetic oligonucleotide
tcccctcagccatcgtggaacaactgcggtgtttc

SEQ ID NO: 3699 - DNA, 36 bp, Artificial Sequence
  Synthetic oligonucleotide
atacgtctgcgattatttagtggtctctcacacata

SEQ ID NO: 3700 - DNA, 36 bp, Artificial Sequence
  Synthetic oligonucleotide
cacgagtcgccacacctcagctgatgctcacctaca

SEQ ID NO: 3701 - DNA, 36 bp, Artificial Sequence
  Synthetic oligonucleotide
agctacgtaccgaatttcgttcataataggtaatga

SEQ ID NO: 3702 - DNA, 35 bp, Artificial Sequence
  Synthetic oligonucleotide
acacattcggccatgtcatcctgcacttcacgtga

SEQ ID NO: 3703 - DNA, 38 bp, Artificial Sequence
  Synthetic oligonucleotide
taaccatcgatcccaacacatgtcagcacggcacctga

SEQ ID NO: 3704 - DNA, 35 bp, Artificial Sequence
  Synthetic oligonucleotide
tacctagtccggccaccagtctcccacacattacg

SEQ ID NO: 3705 - DNA, 35 bp, Artificial Sequence
  Synthetic oligonucleotide
atgtctgcggaccatctatcggatcgccgaacctt

SEQ ID NO: 3706 - DNA, 37 bp, Artificial Sequence
  Synthetic oligonucleotide
cgcacttaccatgcgtatcctttatcggtctgaacga

SEQ ID NO: 3707 - DNA, 37 bp, Artificial Sequence
  Synthetic oligonucleotide
gagtcccggtcccccgggtccatcatctactccatga

SEQ ID NO: 3708 - DNA, 37 bp, Artificial Sequence
  Synthetic oligonucleotide
atctgctgttgtctttcccattagttatcccaatcga

SEQ ID NO: 3709 - DNA, 38 bp, Artificial Sequence
  Synthetic oligonucleotide
agccacacctaatagctcacatccggttaccgtcctga

SEQ ID NO: 3710 - DNA, 38 bp, Artificial Sequence
  Synthetic oligonucleotide
ccggctcagagccacgctatatcttcactactaactga

SEQ ID NO: 3711 - DNA, 37 bp, Artificial Sequence
  Synthetic oligonucleotide
gcgaagtttcacttccagtttctgacgcccttcatga

SEQ ID NO: 3712 - DNA, 36 bp, Artificial Sequence
  Synthetic oligonucleotide
tcctaggctgctcttcgccgcacaccggacttcaca

SEQ ID NO: 3713 - DNA, 38 bp, Artificial Sequence
  Synthetic oligonucleotide
catgcaccggtctcacggtcgcataataactatcatta

SEQ ID NO: 3714 - DNA, 38 bp, Artificial Sequence
  Synthetic oligonucleotide
tgtcaatatctgaatcggtggatattggcggaggttga

SEQ ID NO: 3715 - DNA, 37 bp, Artificial Sequence
  Synthetic oligonucleotide
gggtaccgtgcagactcacagaacctaatatatagga

SEQ ID NO: 3716 - DNA, 37 bp, Artificial Sequence
  Synthetic oligonucleotide
tttaccctgcatcgatcgcgagacccaccaatcatga

SEQ ID NO: 3717 - DNA, 37 bp, Artificial Sequence
  Synthetic oligonucleotide
tggcggcccttctaccgcccgtcaccacctctatgga

SEQ ID NO: 3718 - DNA, 36 bp, Artificial Sequence
  Synthetic oligonucleotide
tacaccaataaccatacaactacatctaatacgtta

SEQ ID NO: 3719 - DNA, 37 bp, Artificial Sequence
  Synthetic oligonucleotide
gagtactcgtgatcttttacacacatctgcctaaaga

SEQ ID NO: 3720 - DNA, 36 bp, Artificial Sequence
  Synthetic oligonucleotide
agcaccggaatgcccgggcccttgtacgcctagtga

SEQ ID NO: 3721 - DNA, 35 bp, Artificial Sequence
  Synthetic oligonucleotide
ttaagtcatctgcactagtacgccctatattaaaa

SEQ ID NO: 3722 - DNA, 37 bp, Artificial Sequence
  Synthetic oligonucleotide
agtctcgcagaaaaaatctatttcccatttgactgga

SEQ ID NO: 3723 - DNA, 36 bp, Artificial Sequence
  Synthetic oligonucleotide
aggaactgcctaccatcgatttttaataccacacga

SEQ ID NO: 3724 - DNA, 36 bp, Artificial Sequence
  Synthetic oligonucleotide
tttcttcttatgagggggaggtgcggttcggaataa

SEQ ID NO: 3725 - DNA, 36 bp, Artificial Sequence
  Synthetic oligonucleotide
gccaggattcggccattttacctatctcgatttaaa

SEQ ID NO: 3726 - DNA, 38 bp, Artificial Sequence
  Synthetic oligonucleotide
cgtgccgaacaactcacacgctacacctttatttttaa

SEQ ID NO: 3727 - DNA, 36 bp, Artificial Sequence
  Synthetic oligonucleotide
agactatcataactccttcacgaaccttccacataa

SEQ ID NO: 3728 - DNA, 37 bp, Artificial Sequence
  Synthetic oligonucleotide
tcaccgaccctcagtacttcccctgcgcatgactaga

SEQ ID NO: 3729 - DNA, 35 bp, Artificial Sequence
  Synthetic oligonucleotide
tctcactactacccactaaaatcggttgatactac

SEQ ID NO: 3730 - DNA, 35 bp, Artificial Sequence
  Synthetic oligonucleotide
acgcacgggtatgcatcattgatggtttccggtac

SEQ ID NO: 3731 - DNA, 38 bp, Artificial Sequence
  Synthetic oligonucleotide
acgttcctgtacgccgcgggcggtattttcacaattga

SEQ ID NO: 3732 - DNA, 38 bp, Artificial Sequence
  Synthetic oligonucleotide
tcgccctatcaactccctgtattttcatccctcaatca

SEQ ID NO: 3733 - DNA, 35 bp, Artificial Sequence
  Synthetic oligonucleotide
cgcctacgatcacttccccgcgcgactgtctcatc

SEQ ID NO: 3734 - DNA, 37 bp, Artificial Sequence
  Synthetic oligonucleotide
cacaacatatctactctatactagctcaattcaccga

SEQ ID NO: 3735 - DNA, 36 bp, Artificial Sequence
  Synthetic oligonucleotide
cattgcgaccttatcccaccacgaattgccactaaa

SEQ ID NO: 3736 - DNA, 35 bp, Artificial Sequence
  Synthetic oligonucleotide
ttactatccagtatcacaccgaccttccaatccga

SEQ ID NO: 3737 - DNA, 37 bp, Artificial Sequence
  Synthetic oligonucleotide
agaacttgatcgtttctggggtttgggaatcatgtga

SEQ ID NO: 3738 - DNA, 35 bp, Artificial Sequence
  Synthetic oligonucleotide
gggcttgcaaacaacttcacgtatgatccgcacct

SEQ ID NO: 3739 - DNA, 35 bp, Artificial Sequence
  Synthetic oligonucleotide
aatcccgtgagggtcgtttcaagtttcaataatcc

SEQ ID NO: 3740 - DNA, 37 bp, Artificial Sequence
  Synthetic oligonucleotide
ggcttacacagccacctatctttggccaatttataga

SEQ ID NO: 3741 - DNA, 36 bp, Artificial Sequence
  Synthetic oligonucleotide
agcgccttaggcttccttctgcggctaaccatcata

SEQ ID NO: 3742 - DNA, 35 bp, Artificial Sequence
  Synthetic oligonucleotide
gaattagctcacttactatttcattttgaccataa

SEQ ID NO: 3743 - DNA, 35 bp, Artificial Sequence
  Synthetic oligonucleotide
ggccttccccttcatccgcctcaacgctggccacc

SEQ ID NO: 3744 - DNA, 36 bp, Artificial Sequence
  Synthetic oligonucleotide
aggcaggcgactacggatcaacatttctatacccta

SEQ ID NO: 3745 - DNA, 36 bp, Artificial Sequence
  Synthetic oligonucleotide
gttagtgcgtattgtaggctgacgaacgctaccgta

SEQ ID NO: 3746 - DNA, 36 bp, Artificial Sequence
  Synthetic oligonucleotide
gcggcccggcgatcctctagtccaaccggtctacta

SEQ ID NO: 3747 - DNA, 38 bp, Artificial Sequence
  Synthetic oligonucleotide
gggggggcacgtacgacattaggtccttaaatcactca

SEQ ID NO: 3748 - DNA, 36 bp, Artificial Sequence
  Synthetic oligonucleotide
taaccgcgtacggactcaagccacccctattaaaca

SEQ ID NO: 3749 - DNA, 35 bp, Artificial Sequence
  Synthetic oligonucleotide
gctatttgttaagtccagtcgcaaatcaccactat

SEQ ID NO: 3750 - DNA, 36 bp, Artificial Sequence
  Synthetic oligonucleotide
ccgggcactcggactttcactctgtcagtttctaca

SEQ ID NO: 3751 - DNA, 36 bp, Artificial Sequence
  Synthetic oligonucleotide
tcgcaatatatatctccgtggtgtaccatcagtcaa

SEQ ID NO: 3752 - DNA, 35 bp, Artificial Sequence
  Synthetic oligonucleotide
ccctctactggcttctacgtcgcacgactgctacc

SEQ ID NO: 3753 - DNA, 34 bp, Artificial Sequence
  Synthetic oligonucleotide
aacctcacatgctggcgatcactagcaaaccacc

SEQ ID NO: 3754 - DNA, 38 bp, Artificial Sequence
  Synthetic oligonucleotide
aaactgccttgaacaagtttcgatatcacattccatga

SEQ ID NO: 3755 - DNA, 35 bp, Artificial Sequence
  Synthetic oligonucleotide
cctcataaccgattaccaacgccatcaaaatatag

SEQ ID NO: 3756 - DNA, 36 bp, Artificial Sequence
  Synthetic oligonucleotide
aacaaggccaaaatacgcatataattctggttgaaa

SEQ ID NO: 3757 - DNA, 35 bp, Artificial Sequence
  Synthetic oligonucleotide
agtgcgaactcttattactgctattaaaactgtcc

SEQ ID NO: 3758 - DNA, 36 bp, Artificial Sequence
  Synthetic oligonucleotide
tcttgctacgtttgttcgcaccaaacttgtcctgca

SEQ ID NO: 3759 - DNA, 34 bp, Artificial Sequence
  Synthetic oligonucleotide
gttctcgcgcgcacatcaattatatcacaaataa

SEQ ID NO: 3760 - DNA, 38 bp, Artificial Sequence
  Synthetic oligonucleotide
atttacgttcgcttcatggacgcggtcataggacctga

SEQ ID NO: 3761 - DNA, 37 bp, Artificial Sequence
  Synthetic oligonucleotide
tcgcaccggccctcaataccatttacacatccacgga

SEQ ID NO: 3762 - DNA, 36 bp, Artificial Sequence
  Synthetic oligonucleotide
ctcgccacgacttaattctcaattcctcacaactga

SEQ ID NO: 3763 - DNA, 36 bp, Artificial Sequence
  Synthetic oligonucleotide
aactgtacggcgcaattttactctcaagtaccaaaa

SEQ ID NO: 3764 - DNA, 36 bp, Artificial Sequence
  Synthetic oligonucleotide
cactgtcaagttttccattccactatacatcaatca

SEQ ID NO: 3765 - DNA, 37 bp, Artificial Sequence
  Synthetic oligonucleotide
ctttcatcataacccggggaatttaccggccgcctca

SEQ ID NO: 3766 - DNA, 38 bp, Artificial Sequence
  Synthetic oligonucleotide
ggtatttgctagatcttcaattacctcgccgtatataa

SEQ ID NO: 3767 - DNA, 35 bp, Artificial Sequence
  Synthetic oligonucleotide
tgcctgcattgctcgtggaggctcattgactttca

SEQ ID NO: 3768 - DNA, 38 bp, Artificial Sequence
  Synthetic oligonucleotide
ctctgtccttgctttctctctcattccgatgactatga

SEQ ID NO: 3769 - DNA, 38 bp, Artificial Sequence
  Synthetic oligonucleotide
gatctccacttcaggcgccattctatacccattaatga

SEQ ID NO: 3770 - DNA, 38 bp, Artificial Sequence
  Synthetic oligonucleotide
tatcaattttattaataccctcattgtgctcctactga

SEQ ID NO: 3771 - DNA, 35 bp, Artificial Sequence
  Synthetic oligonucleotide
gatgcgagaaccactatccatcccacacgccgatt

SEQ ID NO: 3772 - DNA, 36 bp, Artificial Sequence
  Synthetic oligonucleotide
agcactctgtcaggtcgatcattatttcacaacaca

SEQ ID NO: 3773 - DNA, 36 bp, Artificial Sequence
  Synthetic oligonucleotide
gagttcggccctcgttgatcctcgattacaaattaa

SEQ ID NO: 3774 - DNA, 38 bp, Artificial Sequence
  Synthetic oligonucleotide
gggggtacgtccagcttatcatctcataccattattga

SEQ ID NO: 3775 - DNA, 38 bp, Artificial Sequence
  Synthetic oligonucleotide
cgcacgtcacgagcacaccaacactacttcaccactga

SEQ ID NO: 3776 - DNA, 35 bp, Artificial Sequence
  Synthetic oligonucleotide
acatgtcgtccacctatgttgttaccattatttat

SEQ ID NO: 3777 - DNA, 35 bp, Artificial Sequence
  Synthetic oligonucleotide
attcaatcccctcctatggcttgccccccggttct

SEQ ID NO: 3778 - DNA, 36 bp, Artificial Sequence
  Synthetic oligonucleotide
cggtattcgtacgtctgcgcgcaacccattataaca

SEQ ID NO: 3779 - DNA, 38 bp, Artificial Sequence
  Synthetic oligonucleotide
tccatgcagccacgctcagttactactactagtgatga

SEQ ID NO: 3780 - DNA, 35 bp, Artificial Sequence
  Synthetic oligonucleotide
atcacatttccatcgatctccaaggttctcaaact

SEQ ID NO: 3781 - DNA, 35 bp, Artificial Sequence
  Synthetic oligonucleotide
gtgttcctcacactaatcgttctactttcttaact

SEQ ID NO: 3782 - DNA, 36 bp, Artificial Sequence
  Synthetic oligonucleotide
tcacactccatagatctctcggtagacgcagtccga

SEQ ID NO: 3783 - DNA, 36 bp, Artificial Sequence
  Synthetic oligonucleotide
ccattacaacactacctctatatggtcctatccgca

SEQ ID NO: 3784 - DNA, 36 bp, Artificial Sequence
  Synthetic oligonucleotide
cgctatctctacgccaattaagtcgctcctggtaca

SEQ ID NO: 3785 - DNA, 36 bp, Artificial Sequence
  Synthetic oligonucleotide
gcagataccaagtcattactttattatacataacca

SEQ ID NO: 3786 - DNA, 36 bp, Artificial Sequence
  Synthetic oligonucleotide
attcgtactctataaattccaatggcgtacccacaa

SEQ ID NO: 3787 - DNA, 35 bp, Artificial Sequence
  Synthetic oligonucleotide
tcagtacaccattaatcaccatatcacgcattatc

SEQ ID NO: 3788 - DNA, 38 bp, Artificial Sequence
  Synthetic oligonucleotide
aaccgggtacccacaccacccgtaaccatcccaattta

SEQ ID NO: 3789 - DNA, 35 bp, Artificial Sequence
  Synthetic oligonucleotide
aaacggacgcgcgaaactagttggaacattattcc

SEQ ID NO: 3790 - DNA, 35 bp, Artificial Sequence
  Synthetic oligonucleotide
aacaacgaaataggaaatcctctgctgaaccaaat

SEQ ID NO: 3791 - DNA, 35 bp, Artificial Sequence
  Synthetic oligonucleotide
catgccccccgagtttcgtagttattttcctaaac

SEQ ID NO: 3792 - DNA, 35 bp, Artificial Sequence
  Synthetic oligonucleotide
acgcaattcagaacatattcgcaactctttcaaat

SEQ ID NO: 3793 - DNA, 35 bp, Artificial Sequence
  Synthetic oligonucleotide
tttcgaattctccacctgatacccgccacattaaa

SEQ ID NO: 3794 - DNA, 36 bp, Artificial Sequence
  Synthetic oligonucleotide
accctcctattaacccatcaaaagttcgctaccata

SEQ ID NO: 3795 - DNA, 37 bp, Artificial Sequence
  Synthetic oligonucleotide
atactccacaacgaacatccaaactgtttacatcaga

SEQ ID NO: 3796 - DNA, 36 bp, Artificial Sequence
  Synthetic oligonucleotide
gagtacctagccgcaccggtcttaattttcttaaaa

SEQ ID NO: 3797 - DNA, 35 bp, Artificial Sequence
  Synthetic oligonucleotide
aagctgcacggatcttccatgtcccctctattaaa

SEQ ID NO: 3798 - DNA, 37 bp, Artificial Sequence
  Synthetic oligonucleotide
agttctattatggctcctaactgttcttgttttcaga

SEQ ID NO: 3799 - DNA, 36 bp, Artificial Sequence
  Synthetic oligonucleotide
acactcgcctagaagccaccacccatttctcataaa

SEQ ID NO: 3800 - DNA, 37 bp, Artificial Sequence
  Synthetic oligonucleotide
cctccaccatccgaacattaactaattacccgccaga

SEQ ID NO: 3801 - DNA, 35 bp, Artificial Sequence
  Synthetic oligonucleotide
tacttcctatagttacccacatctactaaccaaac

SEQ ID NO: 3802 - DNA, 36 bp, Artificial Sequence
  Synthetic oligonucleotide
gagtactggcacgcgataccctaactgtacatcaca

SEQ ID NO: 3803 - DNA, 35 bp, Artificial Sequence
  Synthetic oligonucleotide
agccagcaaggctagcatcacataattctcatatc

SEQ ID NO: 3804 - DNA, 37 bp, Artificial Sequence
  Synthetic oligonucleotide
atgaatccgcactactaaaacaatttatccttataga

SEQ ID NO: 3805 - DNA, 37 bp, Artificial Sequence
  Synthetic oligonucleotide
tctgtgctggctttagaaggttttctgttttttccta

SEQ ID NO: 3806 - DNA, 35 bp, Artificial Sequence
  Synthetic oligonucleotide
acatagcactgctaggtttatctcattgtttttaa

SEQ ID NO: 3807 - DNA, 38 bp, Artificial Sequence
  Synthetic oligonucleotide
ttctggcaattggcctctcactctctatggttttgtga

SEQ ID NO: 3808 - DNA, 35 bp, Artificial Sequence
  Synthetic oligonucleotide
ttttgatttattctgcttgctgtttgggcttcttt

SEQ ID NO: 3809 - DNA, 38 bp, Artificial Sequence
  Synthetic oligonucleotide
tatattcacaatcgattcttttcacttcctcattttga

SEQ ID NO: 3810 - DNA, 35 bp, Artificial Sequence
  Synthetic oligonucleotide
tgtaggagttgtctctttttcatattttctgtctt

SEQ ID NO: 3811 - DNA, 35 bp, Artificial Sequence
  Synthetic oligonucleotide
taggactggttaatcctccgaaattgtttttctat

SEQ ID NO: 3812 - DNA, 38 bp, Artificial Sequence
  Synthetic oligonucleotide
ttctatcgggggagttcctactctggtttttttcttga

SEQ ID NO: 3813 - DNA, 35 bp, Artificial Sequence
  Synthetic oligonucleotide
gcctgggtggttatttttttccatatcgaaattta

SEQ ID NO: 3814 - DNA, 36 bp, Artificial Sequence
  Synthetic oligonucleotide
ttagttttctcactgtttcccgttgactattctcta

SEQ ID NO: 3815 - DNA, 38 bp, Artificial Sequence
  Synthetic oligonucleotide
ctagtgaccactgcttcttttggttatcttaatcttga

SEQ ID NO: 3816 - DNA, 35 bp, Artificial Sequence
  Synthetic oligonucleotide
gcctgggttgttatttttttccatatcgaaattta

SEQ ID NO: 3817 - DNA, 38 bp, Artificial Sequence
  Synthetic oligonucleotide
tgtatgattttggtttttgttttggtttcacgtggtga

SEQ ID NO: 3818 - DNA, 38 bp, Artificial Sequence
  Synthetic oligonucleotide
gcagtgttatttctcttggtttctttgatttcacttga

SEQ ID NO: 3819 - DNA, 38 bp, Artificial Sequence
  Synthetic oligonucleotide
ttctatcgggggagttcctactcttgtttttttcttga

SEQ ID NO: 3820 - DNA, 38 bp, Artificial Sequence
  Synthetic oligonucleotide
ggcctggttctcgtacatctgtattttggtttttctga

SEQ ID NO: 3821 - DNA, 35 bp, Artificial Sequence
  Synthetic oligonucleotide
gcacccggggtttttatctgagttgtttttcattt

SEQ ID NO: 3822 - DNA, 36 bp, Artificial Sequence
  Synthetic oligonucleotide
tttatccattgtccttggactctcctccgtttagaa

SEQ ID NO: 3823 - DNA, 38 bp, Artificial Sequence
  Synthetic oligonucleotide
ctgcgctggccaatctcatgttttgtttttattaatga

SEQ ID NO: 3824 - DNA, 36 bp, Artificial Sequence
  Synthetic oligonucleotide
tgcttctttaatctgttttctactattttgatataa

SEQ ID NO: 3825 - DNA, 38 bp, Artificial Sequence
  Synthetic oligonucleotide
gatcccgaattgttttcctattaatcgttttcccatga

SEQ ID NO: 3826 - DNA, 38 bp, Artificial Sequence
  Synthetic oligonucleotide
tcccttgggactctttggttattaacatttctctttga

SEQ ID NO: 3827 - DNA, 36 bp, Artificial Sequence
  Synthetic oligonucleotide
tctaactgctggaccctcctgttttttattagtcta

SEQ ID NO: 3828 - DNA, 38 bp, Artificial Sequence
  Synthetic oligonucleotide
gcagtacggaggtttaagttgtttctcctattttttga

SEQ ID NO: 3829 - DNA, 35 bp, Artificial Sequence
  Synthetic oligonucleotide
atgaccgtttcttggaagtttccgattttttttgt

SEQ ID NO: 3830 - DNA, 36 bp, Artificial Sequence
  Synthetic oligonucleotide
taatgcattgttcgcacctggtttttttaatggtta

SEQ ID NO: 3831 - DNA, 38 bp, Artificial Sequence
  Synthetic oligonucleotide
gagcaataattcctgtttctatctctacaaccatttga

SEQ ID NO: 3832 - DNA, 36 bp, Artificial Sequence
  Synthetic oligonucleotide
actgacttaatctaatttgttttccattctcatgaa

SEQ ID NO: 3833 - DNA, 38 bp, Artificial Sequence
  Synthetic oligonucleotide
gtgcacgggcgttttttaatttaagtttcttgttttga

SEQ ID NO: 3834 - DNA, 35 bp, Artificial Sequence
  Synthetic oligonucleotide
ttatactatccaaatctcgtgtctttcctcattat

SEQ ID NO: 3835 - DNA, 36 bp, Artificial Sequence
  Synthetic oligonucleotide
gtcgtaatttgttctttatatctatttcttgttgta

SEQ ID NO: 3836 - DNA, 36 bp, Artificial Sequence
  Synthetic oligonucleotide
ccttggagttgctggtaacctgttgttttttattga

SEQ ID NO: 3837 - DNA, 35 bp, Artificial Sequence
  Synthetic oligonucleotide
acgtgcctgataattatatgtatgtttcttgtttt

SEQ ID NO: 3838 - DNA, 36 bp, Artificial Sequence
  Synthetic oligonucleotide
atctttcacttagtctcggagttttttgtttcctta

SEQ ID NO: 3839 - DNA, 36 bp, Artificial Sequence
  Synthetic oligonucleotide
attcgtttatttttatttcctgattggtttatttca

SEQ ID NO: 3840 - DNA, 35 bp, Artificial Sequence
  Synthetic oligonucleotide
ttcactggtttttttctttctgacctatagattgc

SEQ ID NO: 3841 - DNA, 36 bp, Artificial Sequence
  Synthetic oligonucleotide
ttgctaatttctgggtttgttacgtccttttatata

SEQ ID NO: 3842 - DNA, 36 bp, Artificial Sequence
  Synthetic oligonucleotide
tacttttttgatttttgatcttggcccacgaaataa

SEQ ID NO: 3843 - DNA, 37 bp, Artificial Sequence
  Synthetic oligonucleotide
tctctcttgtcaatagaatttttgtttgtatcttcga

SEQ ID NO: 3844 - DNA, 36 bp, Artificial Sequence
  Synthetic oligonucleotide
tgtgctcactatgtctctccgttgtctgttttttta

SEQ ID NO: 3845 - DNA, 36 bp, Artificial Sequence
  Synthetic oligonucleotide
aatcaagcagggttcaccattgtcgtttttttttta

SEQ ID NO: 3846 - DNA, 38 bp, Artificial Sequence
  Synthetic oligonucleotide
gatgtactgttcgttttgttttgtccttttcatcatga

SEQ ID NO: 3847 - DNA, 36 bp, Artificial Sequence
  Synthetic oligonucleotide
cgcatactgccgcatcgcatttgttttattgttgta

SEQ ID NO: 3848 - DNA, 35 bp, Artificial Sequence
  Synthetic oligonucleotide
ttgtggttgttcatacctgctatcttttttcgttt

SEQ ID NO: 3849 - DNA, 38 bp, Artificial Sequence
  Synthetic oligonucleotide
gagtgatgcggaataaatcgctttgttttgtttcctga

SEQ ID NO: 3850 - DNA, 35 bp, Artificial Sequence
  Synthetic oligonucleotide
ttagtaggtaactttcactgtttttttatcgtttt

SEQ ID NO: 3851 - DNA, 37 bp, Artificial Sequence
  Synthetic oligonucleotide
gggtctctttttctttaactcttttatctaaatttga

SEQ ID NO: 3852 - DNA, 38 bp, Artificial Sequence
  Synthetic oligonucleotide
tgacgtttttttgactggtttttctgaagtggttttga

SEQ ID NO: 3853 - DNA, 35 bp, Artificial Sequence
  Synthetic oligonucleotide
gacgccaccgttttttattttagttgatttagata

SEQ ID NO: 3854 - DNA, 38 bp, Artificial Sequence
  Synthetic oligonucleotide
tcataaatcactctatctttgtttttcagtcttagtga

SEQ ID NO: 3855 - DNA, 35 bp, Artificial Sequence
  Synthetic oligonucleotide
ttacggatgcttttttttgtcctgagattactttt

SEQ ID NO: 3856 - DNA, 35 bp, Artificial Sequence
  Synthetic oligonucleotide
gactgtacgatggcttaattgttttgtattttgtt

SEQ ID NO: 3857 - DNA, 35 bp, Artificial Sequence
  Synthetic oligonucleotide
ttattgtttctaccatgtttgttgcatatgttttt

SEQ ID NO: 3858 - DNA, 38 bp, Artificial Sequence
  Synthetic oligonucleotide
tttttccgttcaactctactttcgatatattatggtga

SEQ ID NO: 3859 - DNA, 37 bp, Artificial Sequence
  Synthetic oligonucleotide
tagtctttccgattgtttttgttatttatatgcctga

SEQ ID NO: 3860 - DNA, 36 bp, Artificial Sequence
  Synthetic oligonucleotide
gcggggcgccctcgatttggttttatttttctcaca

SEQ ID NO: 3861 - DNA, 37 bp, Artificial Sequence
  Synthetic oligonucleotide
tgttacttttttatcttgttctgccatctctaattga

SEQ ID NO: 3862 - DNA, 36 bp, Artificial Sequence
  Synthetic oligonucleotide
tatctatcactaagtttttatatctaaggtccatta

SEQ ID NO: 3863 - DNA, 38 bp, Artificial Sequence
  Synthetic oligonucleotide
ggctttgttcattttcttactctttgtttgtagtttga

SEQ ID NO: 3864 - DNA, 38 bp, Artificial Sequence
  Synthetic oligonucleotide
gccggtttatttaccgagtttttcatcttttcttatga

SEQ ID NO: 3865 - DNA, 37 bp, Artificial Sequence
  Synthetic oligonucleotide
agggtactagcattttcgattttgtgaaattttctga

SEQ ID NO: 3866 - DNA, 38 bp, Artificial Sequence
  Synthetic oligonucleotide
atactgcagtagcacttgtcgtttttctccaatattga

SEQ ID NO: 3867 - DNA, 35 bp, Artificial Sequence
  Synthetic oligonucleotide
ttcgttcctaagaatttgccatttgttttttggtc

SEQ ID NO: 3868 - DNA, 37 bp, Artificial Sequence
  Synthetic oligonucleotide
tcactctatccagcatgcgaggtgttattctatttga

SEQ ID NO: 3869 - DNA, 35 bp, Artificial Sequence
  Synthetic oligonucleotide
agtcgatagaataattttttggttttctcactcat

SEQ ID NO: 3870 - DNA, 35 bp, Artificial Sequence
  Synthetic oligonucleotide
tactgtccttttcaattcgtgtcttggttttatta

SEQ ID NO: 3871 - DNA, 38 bp, Artificial Sequence
  Synthetic oligonucleotide
taaacgtggtactgcgcacggttatttctttctcttga

SEQ ID NO: 3872 - DNA, 38 bp, Artificial Sequence
  Synthetic oligonucleotide
tggggtacttgcctactttttacctggttgttatttga

SEQ ID NO: 3873 - DNA, 38 bp, Artificial Sequence
  Synthetic oligonucleotide
ttggggttaacgttctgatctcgttttcttattattga

SEQ ID NO: 3874 - DNA, 36 bp, Artificial Sequence
  Synthetic oligonucleotide
ggaatgcagcactcgaggttttctttgtttttccca

SEQ ID NO: 3875 - DNA, 38 bp, Artificial Sequence
  Synthetic oligonucleotide
gcgcccaaatccgttgctttgttgttttgtacttttga

SEQ ID NO: 3876 - DNA, 38 bp, Artificial Sequence
  Synthetic oligonucleotide
agtagcctttctctcgatctttgtttgttttttgatga

SEQ ID NO: 3877 - DNA, 38 bp, Artificial Sequence
  Synthetic oligonucleotide
actttcggttgaccatcatatatctctttcttacttga

SEQ ID NO: 3878 - DNA, 35 bp, Artificial Sequence
  Synthetic oligonucleotide
gtcgtaccaatatcggatatcctggtttttctgtc

SEQ ID NO: 3879 - DNA, 38 bp, Artificial Sequence
  Synthetic oligonucleotide
ttactgaacctctccggccctctattttttgaagttga

SEQ ID NO: 3880 - DNA, 35 bp, Artificial Sequence
  Synthetic oligonucleotide
ttttccgtttaattcgatcactttcattgtctcca

SEQ ID NO: 3881 - DNA, 35 bp, Artificial Sequence
  Synthetic oligonucleotide
gcgttgacatgggattctttgtctcttagtctttt

SEQ ID NO: 3882 - DNA, 37 bp, Artificial Sequence
  Synthetic oligonucleotide
agttctattatggctcctaactgttcttgttttccga

SEQ ID NO: 3883 - DNA, 38 bp, Artificial Sequence
  Synthetic oligonucleotide
gctgcactctacacttatggttgtctatcttttactga

SEQ ID NO: 3884 - DNA, 38 bp, Artificial Sequence
  Synthetic oligonucleotide
tgaacgtagcagttttgacatttagtatatctttttga

SEQ ID NO: 3885 - DNA, 35 bp, Artificial Sequence
  Synthetic oligonucleotide
gcggtccgtatgggatttttatttcgttcttgtta

SEQ ID NO: 3886 - DNA, 35 bp, Artificial Sequence
  Synthetic oligonucleotide
ttttaggggtcctgtacattctatccttttatcat

SEQ ID NO: 3887 - DNA, 37 bp, Artificial Sequence
  Synthetic oligonucleotide
ttgtccttccctgttagtctatcatctttcctctgga

SEQ ID NO: 3888 - DNA, 35 bp, Artificial Sequence
  Synthetic oligonucleotide
acgacgccccttttgttgtttttcttggtatcttc

SEQ ID NO: 3889 - DNA, 38 bp, Artificial Sequence
  Synthetic oligonucleotide
gagggccccctatcatattgtttttttatcctccatga

SEQ ID NO: 3890 - DNA, 36 bp, Artificial Sequence
  Synthetic oligonucleotide
tgctgccgtaacactgtttatttctattcttgatta

SEQ ID NO: 3891 - DNA, 37 bp, Artificial Sequence
  Synthetic oligonucleotide
tcgactctggtttgtttttttggtttattacttcgga

SEQ ID NO: 3892 - DNA, 35 bp, Artificial Sequence
  Synthetic oligonucleotide
tgttcaaccggtcccattgttttttgtcgtaatct

SEQ ID NO: 3893 - DNA, 35 bp, Artificial Sequence
  Synthetic oligonucleotide
cacgccttccttttgggttgttgatctcgtttttt

SEQ ID NO: 3894 - DNA, 38 bp, Artificial Sequence
  Synthetic oligonucleotide
aaacgcatttggctcaattgatcttattatttttctga

SEQ ID NO: 3895 - DNA, 36 bp, Artificial Sequence
  Synthetic oligonucleotide
tttaccttgccctggttacgaaatatttgtctctca

SEQ ID NO: 3896 - DNA, 38 bp, Artificial Sequence
  Synthetic oligonucleotide
tataccatcgcttctcatactggggtttatttttttga

SEQ ID NO: 3897 - DNA, 37 bp, Artificial Sequence
  Synthetic oligonucleotide
taaatcgttctcgtaacaccttctatcttttttatga

SEQ ID NO: 3898 - DNA, 35 bp, Artificial Sequence
  Synthetic oligonucleotide
atggatttggccttcactctatgttctcgttttct

SEQ ID NO: 3899 - DNA, 38 bp, Artificial Sequence
  Synthetic oligonucleotide
catcgcatctcgaacgggccttttgttttattatttga

SEQ ID NO: 3900 - DNA, 35 bp, Artificial Sequence
  Synthetic oligonucleotide
gcctttacacatttctgttttgataaagtaattct

SEQ ID NO: 3901 - DNA, 38 bp, Artificial Sequence
  Synthetic oligonucleotide
gtgcgctatctaatgtcaccgtttttttcctcaattga

SEQ ID NO: 3902 - DNA, 37 bp, Artificial Sequence
  Synthetic oligonucleotide
tgtcacgtacctcgtgtttcttttctgttaaacttga

SEQ ID NO: 3903 - DNA, 38 bp, Artificial Sequence
  Synthetic oligonucleotide
aatggaacaaactactttcattttctttctctcattga

SEQ ID NO: 3904 - DNA, 38 bp, Artificial Sequence
  Synthetic oligonucleotide
tttcccaaatctagcttttttcaataatccatatctga

SEQ ID NO: 3905 - DNA, 38 bp, Artificial Sequence
  Synthetic oligonucleotide
ttccatctcaccaatgttggtgactgttgccattttga

SEQ ID NO: 3906 - DNA, 37 bp, Artificial Sequence
  Synthetic oligonucleotide
actcgtgtttttttcgttttgtgcccttcgattctta

SEQ ID NO: 3907 - DNA, 35 bp, Artificial Sequence
  Synthetic oligonucleotide
agtgcccggattagctggctacagtttttttctct

SEQ ID NO: 3908 - DNA, 35 bp, Artificial Sequence
  Synthetic oligonucleotide
aaactccttttttgtatgtcgccatttctttctta

SEQ ID NO: 3909 - DNA, 36 bp, Artificial Sequence
  Synthetic oligonucleotide
tcttggcatgtcctcgttttttgatatctgctttta

SEQ ID NO: 3910 - DNA, 36 bp, Artificial Sequence
  Synthetic oligonucleotide
tgtcgtagtagtgcgcatttgtttaactctctatca

SEQ ID NO: 3911 - DNA, 38 bp, Artificial Sequence
  Synthetic oligonucleotide
tccactgtttacggttttaaattgtttccttgccctga

SEQ ID NO: 3912 - DNA, 38 bp, Artificial Sequence
  Synthetic oligonucleotide
agtccatgcgagctgcatgtactctcggttttttatga

SEQ ID NO: 3913 - DNA, 37 bp, Artificial Sequence
  Synthetic oligonucleotide
gcgtgtttagttaattcgttttttaccaatggggtga

SEQ ID NO: 3914 - DNA, 38 bp, Artificial Sequence
  Synthetic oligonucleotide
agtttcccttccgtttctttctcagtttaactctttga

SEQ ID NO: 3915 - DNA, 38 bp, Artificial Sequence
  Synthetic oligonucleotide
ggtgctccgggcttgtaactttatagttttttccttga

SEQ ID NO: 3916 - DNA, 35 bp, Artificial Sequence
  Synthetic oligonucleotide
gactctttgatctccttgaacgtttttgttatttc

SEQ ID NO: 3917 - DNA, 38 bp, Artificial Sequence
  Synthetic oligonucleotide
tcgtttccaatgatttctcgatttacactccatcttga

SEQ ID NO: 3918 - DNA, 38 bp, Artificial Sequence
  Synthetic oligonucleotide
tttctgtcaacactctcgaacatatatttactccttga

SEQ ID NO: 3919 - DNA, 37 bp, Artificial Sequence
  Synthetic oligonucleotide
acgcggagcggttgtttttttttttgtaatccacaga

SEQ ID NO: 3920 - DNA, 36 bp, Artificial Sequence
  Synthetic oligonucleotide
ttgttaacttttcatctcatctttttcgttacgtga

SEQ ID NO: 3921 - DNA, 38 bp, Artificial Sequence
  Synthetic oligonucleotide
acgttggtgcaaacgttttttgatttctagtattttga

SEQ ID NO: 3922 - DNA, 38 bp, Artificial Sequence
  Synthetic oligonucleotide
tatgccctctaattctgggcttttttttctgttgttga

SEQ ID NO: 3923 - DNA, 38 bp, Artificial Sequence
  Synthetic oligonucleotide
gtttcatcttgttttattagatcttagattttttgtga

SEQ ID NO: 3924 - DNA, 38 bp, Artificial Sequence
  Synthetic oligonucleotide
gcaatgcgatttgtttcgtgtttatcctatctagctga

SEQ ID NO: 3925 - DNA, 38 bp, Artificial Sequence
  Synthetic oligonucleotide
tcgtgcttttctggtagttgaccacactgtttttttga

SEQ ID NO: 3926 - DNA, 38 bp, Artificial Sequence
  Synthetic oligonucleotide
ttccatacgtatatttttttgaaattcgacttttttga

SEQ ID NO: 3927 - DNA, 38 bp, Artificial Sequence
  Synthetic oligonucleotide
acgtttttgacctctagttctgtagcattttgttttga

SEQ ID NO: 3928 - DNA, 38 bp, Artificial Sequence
  Synthetic oligonucleotide
actgaactttttttgtttacgaatccatctattgttga

SEQ ID NO: 3929 - DNA, 38 bp, Artificial Sequence
  Synthetic oligonucleotide
gccgcataggggcaaaattgtttttctctcttacttga

SEQ ID NO: 3930 - DNA, 38 bp, Artificial Sequence
  Synthetic oligonucleotide
accctgggggtttgtaaggctcttttttcgtaatttga

SEQ ID NO: 3931 - DNA, 35 bp, Artificial Sequence
  Synthetic oligonucleotide
agttacataccgtttttcgttacttgaattcaaat

SEQ ID NO: 3932 - DNA, 36 bp, Artificial Sequence
  Synthetic oligonucleotide
acgatcaccacaataatgtctttttttcgttttcta

SEQ ID NO: 3933 - DNA, 36 bp, Artificial Sequence
  Synthetic oligonucleotide
gggactgacatccataatcgggttttttttctagaa

SEQ ID NO: 3934 - DNA, 38 bp, Artificial Sequence
  Synthetic oligonucleotide
atcgggtgcgcccccgaatttttccatgtttttgttga

SEQ ID NO: 3935 - DNA, 37 bp, Artificial Sequence
  Synthetic oligonucleotide
ttttgttacccattttggtccctatcctcactcatga

SEQ ID NO: 3936 - DNA, 36 bp, Artificial Sequence
  Synthetic oligonucleotide
agttggacccgtacgattccctaactttcaacctaa

SEQ ID NO: 3937 - DNA, 36 bp, Artificial Sequence
  Synthetic oligonucleotide
tttctggtctaattatttaaccattctcttgcttta

SEQ ID NO: 3938 - DNA, 38 bp, Artificial Sequence
  Synthetic oligonucleotide
attggcgcctatactgctttgtattgttttcgatttga

SEQ ID NO: 3939 - DNA, 38 bp, Artificial Sequence
  Synthetic oligonucleotide
tcctacaagcaaacggtgaagttgaattttatttttga

SEQ ID NO: 3940 - DNA, 38 bp, Artificial Sequence
  Synthetic oligonucleotide
actgctgactgttttatttgacgataataattttttga

SEQ ID NO: 3941 - DNA, 35 bp, Artificial Sequence
  Synthetic oligonucleotide
tttggtcgtatattctatttttggatgtgaattac

SEQ ID NO: 3942 - DNA, 38 bp, Artificial Sequence
  Synthetic oligonucleotide
tacggtacatggtggagtctcttttgataattttttga

SEQ ID NO: 3943 - DNA, 38 bp, Artificial Sequence
  Synthetic oligonucleotide
ttttgcaatggtgattaatgcggttcgcctgtttttga

SEQ ID NO: 3944 - DNA, 35 bp, Artificial Sequence
  Synthetic oligonucleotide
aggttgcagtccgggatctttattgttaatattta

SEQ ID NO: 3945 - DNA, 36 bp, Artificial Sequence
  Synthetic oligonucleotide
gtttaggctgtcaatggccttttgtttttattttaa

SEQ ID NO: 3946 - DNA, 38 bp, Artificial Sequence
  Synthetic oligonucleotide
aggacttattacattctctgtgttccttatctttatga

SEQ ID NO: 3947 - DNA, 35 bp, Artificial Sequence
  Synthetic oligonucleotide
gctctttcctgtcttgtttatttcgttggttttcc

SEQ ID NO: 3948 - DNA, 35 bp, Artificial Sequence
  Synthetic oligonucleotide
gggttacgtacccgactttttttctggttttctct

SEQ ID NO: 3949 - DNA, 36 bp, Artificial Sequence
  Synthetic oligonucleotide
tcgcaagctaatagctttattttttctgtctttcta

SEQ ID NO: 3950 - DNA, 38 bp, Artificial Sequence
  Synthetic oligonucleotide
ttactatgcatcgtttgaatccgttgtttctccactga

SEQ ID NO: 3951 - DNA, 38 bp, Artificial Sequence
  Synthetic oligonucleotide
tggagtttctgctgctcgacttggtatcctgtttgtga

SEQ ID NO: 3952 - DNA, 38 bp, Artificial Sequence
  Synthetic oligonucleotide
gagtaccgtgtcaacgtttttttttgtattatcaatga

SEQ ID NO: 3953 - DNA, 38 bp, Artificial Sequence
  Synthetic oligonucleotide
tctattaacccgtttacgtgctcacctcgtttttttga

SEQ ID NO: 3954 - DNA, 37 bp, Artificial Sequence
  Synthetic oligonucleotide
gcatgagctcatttgttttatcttgtcgttttttgga

SEQ ID NO: 3955 - DNA, 38 bp, Artificial Sequence
  Synthetic oligonucleotide
ttatctctatactatgttgtttctctatttaccactga

SEQ ID NO: 3956 - DNA, 37 bp, Artificial Sequence
  Synthetic oligonucleotide
tagctcacgacgatttattttctcatttcttatttga

SEQ ID NO: 3957 - DNA, 35 bp, Artificial Sequence
  Synthetic oligonucleotide
ttgcaaggcatccgccttgagttttttttcagttt

SEQ ID NO: 3958 - DNA, 36 bp, Artificial Sequence
  Synthetic oligonucleotide
gcgttgtttcgttatggggtttcttctcacaatgga

SEQ ID NO: 3959 - DNA, 37 bp, Artificial Sequence
  Synthetic oligonucleotide
gcaaatctccttgtttatccatctattcctcttagga

SEQ ID NO: 3960 - DNA, 37 bp, Artificial Sequence
  Synthetic oligonucleotide
gccgtgcttctctttctttttcggttaaatttcttga

SEQ ID NO: 3961 - DNA, 38 bp, Artificial Sequence
  Synthetic oligonucleotide
gtaggcctttgatttctttccttccgtttcttttgtga

SEQ ID NO: 3962 - DNA, 37 bp, Artificial Sequence
  Synthetic oligonucleotide
atctcggtaatctcatcatgggggttgtttattttga

SEQ ID NO: 3963 - DNA, 37 bp, Artificial Sequence
  Synthetic oligonucleotide
gcaggccgttcctcatatttgttgaattggttgttga

SEQ ID NO: 3964 - DNA, 38 bp, Artificial Sequence
  Synthetic oligonucleotide
accgaacttttttcggattcctcggggtttttttttga

SEQ ID NO: 3965 - DNA, 36 bp, Artificial Sequence
  Synthetic oligonucleotide
tggagtactgggcttgtccgtaatttttatgtaaca

SEQ ID NO: 3966 - DNA, 35 bp, Artificial Sequence
  Synthetic oligonucleotide
tccatgtacgtcgatattgacatctttatttttta

SEQ ID NO: 3967 - DNA, 38 bp, Artificial Sequence
  Synthetic oligonucleotide
atgttaggccacgattgttttattgttgatttttttga

SEQ ID NO: 3968 - DNA, 38 bp, Artificial Sequence
  Synthetic oligonucleotide
gcggctcgcattgctttttatttcgtagactatcctga

SEQ ID NO: 3969 - DNA, 38 bp, Artificial Sequence
  Synthetic oligonucleotide
tctacctggatggcgataattttttttgatctttttga

SEQ ID NO: 3970 - DNA, 35 bp, Artificial Sequence
  Synthetic oligonucleotide
gagtgcccattagtaatttttcttccactttattt

SEQ ID NO: 3971 - DNA, 37 bp, Artificial Sequence
  Synthetic oligonucleotide
gagtttccctttttattagtgccttttagttgtttga

SEQ ID NO: 3972 - DNA, 38 bp, Artificial Sequence
  Synthetic oligonucleotide
ccataacacttggaggttctttgtttgttttgttttga

SEQ ID NO: 3973 - DNA, 38 bp, Artificial Sequence
  Synthetic oligonucleotide
ttatttcctctcttaacgttttttactaacctatatga

SEQ ID NO: 3974 - DNA, 37 bp, Artificial Sequence
  Synthetic oligonucleotide
ccgtccgctcctttaatccgttttgtttttctgctga

SEQ ID NO: 3975 - DNA, 35 bp, Artificial Sequence
  Synthetic oligonucleotide
taattggcttttttacttatatttcctcatttgtt

SEQ ID NO: 3976 - DNA, 35 bp, Artificial Sequence
  Synthetic oligonucleotide
tactacaggcctctttcgattttccgggtgttttt

SEQ ID NO: 3977 - DNA, 36 bp, Artificial Sequence
  Synthetic oligonucleotide
gttctgtggttcgttttcttaatgttagtactctca

SEQ ID NO: 3978 - DNA, 37 bp, Artificial Sequence
  Synthetic oligonucleotide
ggctgttttttcttgtatttcggatttaccaatatga

SEQ ID NO: 3979 - DNA, 35 bp, Artificial Sequence
  Synthetic oligonucleotide
gggggactatctactaggctttcgttttttcctct

SEQ ID NO: 3980 - DNA, 35 bp, Artificial Sequence
  Synthetic oligonucleotide
agcaattatgtgcgtttgtttttaatttatgttca

SEQ ID NO: 3981 - DNA, 37 bp, Artificial Sequence
  Synthetic oligonucleotide
ttccacacggtgttgaacatttgttttattgatttga

SEQ ID NO: 3982 - DNA, 36 bp, Artificial Sequence
  Synthetic oligonucleotide
ggtgtcgcttatttttatctttgaattggtcataaa

SEQ ID NO: 3983 - DNA, 36 bp, Artificial Sequence
  Synthetic oligonucleotide
aacttttattgatatacgcatttttttcctgggata

SEQ ID NO: 3984 - DNA, 37 bp, Artificial Sequence
  Synthetic oligonucleotide
catggtcgtttttctgtcctctaaacttactatccga

SEQ ID NO: 3985 - DNA, 38 bp, Artificial Sequence
  Synthetic oligonucleotide
tagtctatggcttggctttccatggtttcctttcttga

SEQ ID NO: 3986 - DNA, 38 bp, Artificial Sequence
  Synthetic oligonucleotide
agcactttcgtcatagtggttattgttgtaaattgtga

SEQ ID NO: 3987 - DNA, 36 bp, Artificial Sequence
  Synthetic oligonucleotide
ttaagcgtacgaccgagtttttatatcatatcttga

SEQ ID NO: 3988 - DNA, 36 bp, Artificial Sequence
  Synthetic oligonucleotide
gctctctctggtataggtttttttttgttatccaca

SEQ ID NO: 3989 - DNA, 36 bp, Artificial Sequence
  Synthetic oligonucleotide
tgcctaggtatatttcgaattttcataggattttca

SEQ ID NO: 3990 - DNA, 37 bp, Artificial Sequence
  Synthetic oligonucleotide
ttcttttttatgatgatccgatcctattttctttcga

SEQ ID NO: 3991 - DNA, 36 bp, Artificial Sequence
  Synthetic oligonucleotide
ttgttttccttgttatgtttaaactgtcaaaatcca

SEQ ID NO: 3992 - DNA, 37 bp, Artificial Sequence
  Synthetic oligonucleotide
tactgcagatattttaagtttctgttaatctttgtga

SEQ ID NO: 3993 - DNA, 35 bp, Artificial Sequence
  Synthetic oligonucleotide
ttctctcaaaatagtttttctttccgcaggatgta

SEQ ID NO: 3994 - DNA, 38 bp, Artificial Sequence
  Synthetic oligonucleotide
ttttagcgtaactggatttttttcacgacgttttctga

SEQ ID NO: 3995 - DNA, 38 bp, Artificial Sequence
  Synthetic oligonucleotide
catgcatggctttctttccatgttctttctatccatga

SEQ ID NO: 3996 - DNA, 36 bp, Artificial Sequence
  Synthetic oligonucleotide
acatgcgaccgttttcttgactttcttcgttattga

SEQ ID NO: 3997 - DNA, 38 bp, Artificial Sequence
  Synthetic oligonucleotide
agctcctgttttccatttcaaatcacgttaatctatga

SEQ ID NO: 3998 - DNA, 38 bp, Artificial Sequence
  Synthetic oligonucleotide
acggcgcctctcctgattttccatcttttctttcctga

SEQ ID NO: 3999 - DNA, 35 bp, Artificial Sequence
  Synthetic oligonucleotide
tcgatatctcttgtttttgttaaattcgtcttcaa

SEQ ID NO: 4000 - DNA, 38 bp, Artificial Sequence
  Synthetic oligonucleotide
ctctgtcccaaatccgtatccattttttcttactctga

SEQ ID NO: 4001 - DNA, 35 bp, Artificial Sequence
  Synthetic oligonucleotide
gtgcttcgctctctgagtttttcatctgtcaattt

SEQ ID NO: 4002 - DNA, 38 bp, Artificial Sequence
  Synthetic oligonucleotide
aagcaacgctgacctttcagactttttttatttgttga

SEQ ID NO: 4003 - DNA, 38 bp, Artificial Sequence
  Synthetic oligonucleotide
actctttctgggggtttttcttcttatagatttcttga

SEQ ID NO: 4004 - DNA, 36 bp, Artificial Sequence
  Synthetic oligonucleotide
ttatggtacactctctattgatgtttttctatctta

SEQ ID NO: 4005 - DNA, 36 bp, Artificial Sequence
  Synthetic oligonucleotide
ccctcaattaattatgcttgtattttgtttctatct

SEQ ID NO: 4006 - DNA, 38 bp, Artificial Sequence
  Synthetic oligonucleotide
ttctcgctgtttgttttcccattatgttacgctattga

SEQ ID NO: 4007 - DNA, 37 bp, Artificial Sequence
  Synthetic oligonucleotide
gaggttttgcgattggattttttggttgttatcttga

SEQ ID NO: 4008 - DNA, 36 bp, Artificial Sequence
  Synthetic oligonucleotide
aacccgtagtagcacaccctgtcgaacccaaataaa

SEQ ID NO: 4009 - DNA, 36 bp, Artificial Sequence
  Synthetic oligonucleotide
aacacttctaggttcgcaaccccttataaccctaaa

SEQ ID NO: 4010 - DNA, 35 bp, Artificial Sequence
  Synthetic oligonucleotide
actccgcaatattccttttaaatttaggttgcaac

SEQ ID NO: 4011 - DNA, 35 bp, Artificial Sequence
  Synthetic oligonucleotide
acttcaacgagcgttgatagctcggattttatcaa

SEQ ID NO: 4012 - DNA, 36 bp, Artificial Sequence
  Synthetic oligonucleotide
tctgcataacaaactcgacacgccctagccccaata

SEQ ID NO: 4013 - DNA, 37 bp, Artificial Sequence
  Synthetic oligonucleotide
gagtacctcatcgcatatcgagcgcactttatacaga

SEQ ID NO: 4014 - DNA, 35 bp, Artificial Sequence
  Synthetic oligonucleotide
accccaataccattgcacctgaggactcaatcaat

SEQ ID NO: 4015 - DNA, 36 bp, Artificial Sequence
  Synthetic oligonucleotide
ttccaccgagttcctttccagccaatatagcatata

SEQ ID NO: 4016 - DNA, 35 bp, Artificial Sequence
  Synthetic oligonucleotide
ctcattcgctaccaaccctgtgatctcttctaaac

SEQ ID NO: 4017 - DNA, 35 bp, Artificial Sequence
  Synthetic oligonucleotide
aactgtcatccgccgactaactcaatctaactaca

SEQ ID NO: 4018 - DNA, 36 bp, Artificial Sequence
  Synthetic oligonucleotide
gagtactggcacgcgataccctaactgtacatcaaa

SEQ ID NO: 4019 - DNA, 37 bp, Artificial Sequence
  Synthetic oligonucleotide
ggctgcacttatctgtaacacatcactattccccaga

SEQ ID NO: 4020 - DNA, 36 bp, Artificial Sequence
  Synthetic oligonucleotide
tatctcaactcttctatatcacatgaccataataaa

SEQ ID NO: 4021 - DNA, 35 bp, Artificial Sequence
  Synthetic oligonucleotide
tgaacacgaaaaaactaagcattaaatcacacacc

SEQ ID NO: 4022 - DNA, 35 bp, Artificial Sequence
  Synthetic oligonucleotide
aattaaccaacaaacccataacgagtccctttatt

SEQ ID NO: 4023 - DNA, 35 bp, Artificial Sequence
  Synthetic oligonucleotide
aatgtaactggcaatttctttctcactgatttctc

SEQ ID NO: 4024 - DNA, 36 bp, Artificial Sequence
  Synthetic oligonucleotide
acaatactgcctccacacttccaccttcttttgtca

SEQ ID NO: 4025 - DNA, 35 bp, Artificial Sequence
  Synthetic oligonucleotide
acactatcaagcgcttcgcatttcctttctccaat

SEQ ID NO: 4026 - DNA, 35 bp, Artificial Sequence
  Synthetic oligonucleotide
acccgtgcggcttaaccttatcttctttatttcat

SEQ ID NO: 4027 - DNA, 35 bp, Artificial Sequence
  Synthetic oligonucleotide
accgctggggctctttccgacaatttcttccattt

SEQ ID NO: 4028 - DNA, 35 bp, Artificial Sequence
  Synthetic oligonucleotide
acgcaaccgtagcaaatttcttagtgttttttttt

SEQ ID NO: 4029 - DNA, 38 bp, Artificial Sequence
  Synthetic oligonucleotide
acgggtcacgccttccactttacttggttttattttga

SEQ ID NO: 4030 - DNA, 36 bp, Artificial Sequence
  Synthetic oligonucleotide
agcagtcattttacttctgttttccttaaaattcta

SEQ ID NO: 4031 - DNA, 38 bp, Artificial Sequence
  Synthetic oligonucleotide
agccagtcacaacttctcgtttcgctctctttttctga

SEQ ID NO: 4032 - DNA, 38 bp, Artificial Sequence
  Synthetic oligonucleotide
agctaccggggtttaccttcctttcttctctcctctga

SEQ ID NO: 4033 - DNA, 38 bp, Artificial Sequence
  Synthetic oligonucleotide
agttggcttgtcatcatttttttgcttatcttctctga

SEQ ID NO: 4034 - DNA, 36 bp, Artificial Sequence
  Synthetic oligonucleotide
atccaaacgatcaccttggtctctctttacttttca

SEQ ID NO: 4035 - DNA, 35 bp, Artificial Sequence
  Synthetic oligonucleotide
atccttatttctatctcatcctcttgtcgccgact

SEQ ID NO: 4036 - DNA, 35 bp, Artificial Sequence
  Synthetic oligonucleotide
atcgaaggtactacgtaaatttctcattctctttt

SEQ ID NO: 4037 - DNA, 35 bp, Artificial Sequence
  Synthetic oligonucleotide
atggtctgtcatggcaccgattacatttctttctc

SEQ ID NO: 4038 - DNA, 35 bp, Artificial Sequence
  Synthetic oligonucleotide
atgtgctcttcgttatttctcttatttctatcttt

SEQ ID NO: 4039 - DNA, 35 bp, Artificial Sequence
  Synthetic oligonucleotide
attacttctgctccattttccttttttcatacatt

SEQ ID NO: 4040 - DNA, 35 bp, Artificial Sequence
  Synthetic oligonucleotide
attcctgcgttgcgtatcttccttcgcttattttc

SEQ ID NO: 4041 - DNA, 37 bp, Artificial Sequence
  Synthetic oligonucleotide
ccccactatttatccgcacatcttttgttctctttga

SEQ ID NO: 4042 - DNA, 35 bp, Artificial Sequence
  Synthetic oligonucleotide
cctccgccttactttcttatttctctttacgaatt

SEQ ID NO: 4043 - DNA, 35 bp, Artificial Sequence
  Synthetic oligonucleotide
cgaggaccgacttttccacttatctttgccctttt

SEQ ID NO: 4044 - DNA, 37 bp, Artificial Sequence
  Synthetic oligonucleotide
ctccatcgaactctatctctttttcttaacaatccga

SEQ ID NO: 4045 - DNA, 36 bp, Artificial Sequence
  Synthetic oligonucleotide
gagtacctcacaattttcccgcgacgccctttttta

SEQ ID NO: 4046 - DNA, 37 bp, Artificial Sequence
  Synthetic oligonucleotide
gatcccgttccttttttaacgctctattttcttttga

SEQ ID NO: 4047 - DNA, 35 bp, Artificial Sequence
  Synthetic oligonucleotide
gcaaatgcctttcattacccattgcttttctgaca

SEQ ID NO: 4048 - DNA, 36 bp, Artificial Sequence
  Synthetic oligonucleotide
gcaatgaacacctacacatacctgcctacacgatta

SEQ ID NO: 4049 - DNA, 36 bp, Artificial Sequence
  Synthetic oligonucleotide
gcaatttttcattcttagggtttctctcacttccca

SEQ ID NO: 4050 - DNA, 38 bp, Artificial Sequence
  Synthetic oligonucleotide
gcacatttcttaacttttctgtttggatttaccaatga

SEQ ID NO: 4051 - DNA, 37 bp, Artificial Sequence
  Synthetic oligonucleotide
gcacggcttacgctcttcttttccgctatctatttga

SEQ ID NO: 4052 - DNA, 36 bp, Artificial Sequence
  Synthetic oligonucleotide
gcagttcgcctccactcactcttttccgatttatca

SEQ ID NO: 4053 - DNA, 35 bp, Artificial Sequence
  Synthetic oligonucleotide
gcatcctcccgtgtcgctcacttttcctttgcttc

SEQ ID NO: 4054 - DNA, 38 bp, Artificial Sequence
  Synthetic oligonucleotide
gccaactttgaatgggctctcatcctatctctctttga

SEQ ID NO: 4055 - DNA, 36 bp, Artificial Sequence
  Synthetic oligonucleotide
gcccgcgctcgcatcctatttcttctttttttgtaa

SEQ ID NO: 4056 - DNA, 35 bp, Artificial Sequence
  Synthetic oligonucleotide
gccctcgtactcttctttggaacttactttcattt

SEQ ID NO: 4057 - DNA, 37 bp, Artificial Sequence
  Synthetic oligonucleotide
gccgcattatttcgttttttcttcactctgcacttga

SEQ ID NO: 4058 - DNA, 38 bp, Artificial Sequence
  Synthetic oligonucleotide
gcctatcttactatatctcgtttactttccttatatga

SEQ ID NO: 4059 - DNA, 37 bp, Artificial Sequence
  Synthetic oligonucleotide
gcctgtacctgtttacttttatcaatcttgtgcttga

SEQ ID NO: 4060 - DNA, 36 bp, Artificial Sequence
  Synthetic oligonucleotide
gccttccgcttggtgttttttttacttttagatcta

SEQ ID NO: 4061 - DNA, 35 bp, Artificial Sequence
  Synthetic oligonucleotide
gcgatggtctaccttcttttaacaaattttcgctc

SEQ ID NO: 4062 - DNA, 38 bp, Artificial Sequence
  Synthetic oligonucleotide
gcgccttacgttaattcacatatccctttaccatctga

SEQ ID NO: 4063 - DNA, 38 bp, Artificial Sequence
  Synthetic oligonucleotide
gcggtctgggaatttctaccctgcttctatctttttga

SEQ ID NO: 4064 - DNA, 35 bp, Artificial Sequence
  Synthetic oligonucleotide
gctacgccttactctctgataatctccactttccg

SEQ ID NO: 4065 - DNA, 35 bp, Artificial Sequence
  Synthetic oligonucleotide
gctatctgagctcccgctttctttcgattatatat

SEQ ID NO: 4066 - DNA, 35 bp, Artificial Sequence
  Synthetic oligonucleotide
ggcccgatttcctatgtcatttggttttttctttc

SEQ ID NO: 4067 - DNA, 35 bp, Artificial Sequence
  Synthetic oligonucleotide
ggccgtcgcatacctagatttctttatcctttttc

SEQ ID NO: 4068 - DNA, 38 bp, Artificial Sequence
  Synthetic oligonucleotide
ggcgccaatttccttctatcgcaattcatttcctctga

SEQ ID NO: 4069 - DNA, 36 bp, Artificial Sequence
  Synthetic oligonucleotide
ggctaggccgccttcttatctttatgcccttgttaa

SEQ ID NO: 4070 - DNA, 35 bp, Artificial Sequence
  Synthetic oligonucleotide
ggcttcttatttgcttgaatatccgcttcctctat

SEQ ID NO: 4071 - DNA, 36 bp, Artificial Sequence
  Synthetic oligonucleotide
gggcacggttttttcttttctggtcgctatccctta

SEQ ID NO: 4072 - DNA, 35 bp, Artificial Sequence
  Synthetic oligonucleotide
ggtaccctgattttttctcgcctattttaatattt

SEQ ID NO: 4073 - DNA, 35 bp, Artificial Sequence
  Synthetic oligonucleotide
ggtccaattacccttttcaacttatcgcaccattt

SEQ ID NO: 4074 - DNA, 36 bp, Artificial Sequence
  Synthetic oligonucleotide
gtttcgtggtatgcgaaccttctattacttatttta

SEQ ID NO: 4075 - DNA, 35 bp, Artificial Sequence
  Synthetic oligonucleotide
gttttcttcccggttaaccctttattttttttggt

SEQ ID NO: 4076 - DNA, 38 bp, Artificial Sequence
  Synthetic oligonucleotide
tacactttctctagttactactcaccttctttctctga

SEQ ID NO: 4077 - DNA, 35 bp, Artificial Sequence
  Synthetic oligonucleotide
tagttacttttaatcaatactctctatttttttgc

SEQ ID NO: 4078 - DNA, 35 bp, Artificial Sequence
  Synthetic oligonucleotide
tatccttcgcattattctttctcatcggtccttta

SEQ ID NO: 4079 - DNA, 35 bp, Artificial Sequence
  Synthetic oligonucleotide
tatctttattgctctgggtgattgcctcttgtttt

SEQ ID NO: 4080 - DNA, 35 bp, Artificial Sequence
  Synthetic oligonucleotide
tatttcccacgctattcatctattctctttacctt

SEQ ID NO: 4081 - DNA, 36 bp, Artificial Sequence
  Synthetic oligonucleotide
tccactggcttggcattgcctccttgatccttctta

SEQ ID NO: 4082 - DNA, 35 bp, Artificial Sequence
  Synthetic oligonucleotide
tccagcacgcaacctcagcttcatctttttctctt

SEQ ID NO: 4083 - DNA, 35 bp, Artificial Sequence
  Synthetic oligonucleotide
tccatttgtactgtgcgcctaattttctactcttt

SEQ ID NO: 4084 - DNA, 35 bp, Artificial Sequence
  Synthetic oligonucleotide
tccgacctggttatttttttgcctttttctattat

SEQ ID NO: 4085 - DNA, 36 bp, Artificial Sequence
  Synthetic oligonucleotide
tcgcgatttcccatgtctctatacttcttacaccca

SEQ ID NO: 4086 - DNA, 35 bp, Artificial Sequence
  Synthetic oligonucleotide
tcgtacgagatgcactctttctacttaagttttct

SEQ ID NO: 4087 - DNA, 37 bp, Artificial Sequence
  Synthetic oligonucleotide
tcgtcattgccttcctttttcatgtttcattttctga

SEQ ID NO: 4088 - DNA, 35 bp, Artificial Sequence
  Synthetic oligonucleotide
tcgtgatctctatttggtttcttccacgcatttct

SEQ ID NO: 4089 - DNA, 36 bp, Artificial Sequence
  Synthetic oligonucleotide
tcgttctatccgtttgtgcatcttccttctttacca

SEQ ID NO: 4090 - DNA, 35 bp, Artificial Sequence
  Synthetic oligonucleotide
tctaggcatctccgcttcctaaatttctttctgta

SEQ ID NO: 4091 - DNA, 35 bp, Artificial Sequence
  Synthetic oligonucleotide
tctgcccgcactactaaatttttatctcttcacta

SEQ ID NO: 4092 - DNA, 36 bp, Artificial Sequence
  Synthetic oligonucleotide
tctttagcatctcatcttttctgccctcacgcctta

SEQ ID NO: 4093 - DNA, 35 bp, Artificial Sequence
  Synthetic oligonucleotide
tgcacgaggattaccttttctttttctcgattctt

SEQ ID NO: 4094 - DNA, 36 bp, Artificial Sequence
  Synthetic oligonucleotide
tgcttatcccgggaatatcctttgctctcttttcca

SEQ ID NO: 4095 - DNA, 38 bp, Artificial Sequence
  Synthetic oligonucleotide
tggctctcacgtctccattttattttctatttttctga

SEQ ID NO: 4096 - DNA, 37 bp, Artificial Sequence
  Synthetic oligonucleotide
tggggcttaaccatctcttctttctcttttaccagga

SEQ ID NO: 4097 - DNA, 36 bp, Artificial Sequence
  Synthetic oligonucleotide
tggtactaacctctatctcatcctaaaatctcttta

SEQ ID NO: 4098 - DNA, 35 bp, Artificial Sequence
  Synthetic oligonucleotide
tgtcgacctttaccttattcatttgaaatcgcttt

SEQ ID NO: 4099 - DNA, 36 bp, Artificial Sequence
  Synthetic oligonucleotide
ttccttgcaatttcctttctttttattcatccggca

SEQ ID NO: 4100 - DNA, 37 bp, Artificial Sequence
  Synthetic oligonucleotide
ttcgacccttttccatactttttctcacgcaaattga

SEQ ID NO: 4101 - DNA, 38 bp, Artificial Sequence
  Synthetic oligonucleotide
ttctcgatcctttgccgcatttctcacttttctgttga

SEQ ID NO: 4102 - DNA, 36 bp, Artificial Sequence
  Synthetic oligonucleotide
ttctcgtagctacaaatcctttaacacttctcttca

SEQ ID NO: 4103 - DNA, 38 bp, Artificial Sequence
  Synthetic oligonucleotide
ttgcgacgcctctactttcaccccactaaaatttctga

SEQ ID NO: 4104 - DNA, 35 bp, Artificial Sequence
  Synthetic oligonucleotide
ttgtacgttcgctttattttgcattccgccttttt

SEQ ID NO: 4105 - DNA, 37 bp, Artificial Sequence
  Synthetic oligonucleotide
tttcctcgctatttctgtctctttgcccttcttggga

SEQ ID NO: 4106 - DNA, 37 bp, Artificial Sequence
  Synthetic oligonucleotide
ttttcaggtacgaccccatacttttttttcattttga

SEQ ID NO: 4107 - DNA, 35 bp, Artificial Sequence
  Synthetic oligonucleotide
aacgccgtacagttgctgatttcacccactctttt

SEQ ID NO: 4108 - DNA, 35 bp, Artificial Sequence
  Synthetic oligonucleotide
actccttctaaaattacacttatatcacccatacc

SEQ ID NO: 4109 - DNA, 35 bp, Artificial Sequence
  Synthetic oligonucleotide
agaaccgtccctgcatttttattggttattttttt

SEQ ID NO: 4110 - DNA, 38 bp, Artificial Sequence
  Synthetic oligonucleotide
cttgcatattgttcttcctgtttgctttttcttcttga

SEQ ID NO: 4111 - DNA, 35 bp, Artificial Sequence
  Synthetic oligonucleotide
gagtaccctattacgctccccccccattatctctt

SEQ ID NO: 4112 - DNA, 38 bp, Artificial Sequence
  Synthetic oligonucleotide
gcaccttctattttcaccccgatttaccctttgcctga

SEQ ID NO: 4113 - DNA, 38 bp, Artificial Sequence
  Synthetic oligonucleotide
gccgccttgggtccattattatctttatatttttctga

SEQ ID NO: 4114 - DNA, 38 bp, Artificial Sequence
  Synthetic oligonucleotide
gccgcttgcctttatttatcatacgctattaatcttga

SEQ ID NO: 4115 - DNA, 35 bp, Artificial Sequence
  Synthetic oligonucleotide
gcctggttatctttgaatagctttcgtattccttt

SEQ ID NO: 4116 - DNA, 36 bp, Artificial Sequence
  Synthetic oligonucleotide
gccttgcatcttcacttatggtgtcttaccacttta

SEQ ID NO: 4117 - DNA, 35 bp, Artificial Sequence
  Synthetic oligonucleotide
gcgaggctattatctctggcgctgttcgcccactt

SEQ ID NO: 4118 - DNA, 37 bp, Artificial Sequence
  Synthetic oligonucleotide
gctagcatgcactcctttacttcttctcatcacacga

SEQ ID NO: 4119 - DNA, 37 bp, Artificial Sequence
  Synthetic oligonucleotide
gttcaacttatcttcctttttctttctgggactggga

SEQ ID NO: 4120 - DNA, 35 bp, Artificial Sequence
  Synthetic oligonucleotide
taccgctccactcttctttattttcggtatctttc

SEQ ID NO: 4121 - DNA, 35 bp, Artificial Sequence
  Synthetic oligonucleotide
tctagccgtcactattcttcgtacgtttccatcct

SEQ ID NO: 4122 - DNA, 38 bp, Artificial Sequence
  Synthetic oligonucleotide
tctcactactcgctctttttccttttctccacttatga

SEQ ID NO: 4123 - DNA, 35 bp, Artificial Sequence
  Synthetic oligonucleotide
tcttacctaatttcttactctgccactttacacgc

SEQ ID NO: 4124 - DNA, 38 bp, Artificial Sequence
  Synthetic oligonucleotide
tggtacgtactcgcgccgcggtctttttcttttcctga

SEQ ID NO: 4125 - DNA, 36 bp, Artificial Sequence
  Synthetic oligonucleotide
ttttacttacccataatttccttacattactttata

SEQ ID NO: 4126 - DNA, 36 bp, Artificial Sequence
  Synthetic oligonucleotide
aaatagctcgcacgagtagccccgatagaaacataa

SEQ ID NO: 4127 - DNA, 37 bp, Artificial Sequence
  Synthetic oligonucleotide
aatcaaatcatacaatagagaccgaaattacaaccga

SEQ ID NO: 4128 - DNA, 36 bp, Artificial Sequence
  Synthetic oligonucleotide
acaggcttggttcaacgaaaatcttcagttccggaa

SEQ ID NO: 4129 - DNA, 35 bp, Artificial Sequence
  Synthetic oligonucleotide
accctggggtgtccgggataaaaatatacaaatca

SEQ ID NO: 4130 - DNA, 36 bp, Artificial Sequence
  Synthetic oligonucleotide
agagaataaaatgggggctagaagctaaaaatataa

SEQ ID NO: 4131 - DNA, 38 bp, Artificial Sequence
  Synthetic oligonucleotide
cgtgcacattctaacggaatcagtaccacacaccatga

SEQ ID NO: 4132 - DNA, 35 bp, Artificial Sequence
  Synthetic oligonucleotide
ctgcttaaaactatcccataatcctaatgaccgga

SEQ ID NO: 4133 - DNA, 36 bp, Artificial Sequence
  Synthetic oligonucleotide
gaatgatttacaccacaattagactactgatatcaa

SEQ ID NO: 4134 - DNA, 37 bp, Artificial Sequence
  Synthetic oligonucleotide
gagttgctgcaagggactccctgaacacttatgacga

SEQ ID NO: 4135 - DNA, 37 bp, Artificial Sequence
  Synthetic oligonucleotide
gcgccgaatagttcgacccgaaaccctaatgaatcga

SEQ ID NO: 4136 - DNA, 38 bp, Artificial Sequence
  Synthetic oligonucleotide
gggctgtgcaaacacaatatataaaaactcaacattga

SEQ ID NO: 4137 - DNA, 35 bp, Artificial Sequence
  Synthetic oligonucleotide
ggtctgcccctgaccgactcaaccgattaagaaca

SEQ ID NO: 4138 - DNA, 35 bp, Artificial Sequence
  Synthetic oligonucleotide
taaaacgaaactaggaaagatacacctaaaaagaa

SEQ ID NO: 4139 - DNA, 35 bp, Artificial Sequence
  Synthetic oligonucleotide
tactaacaacgggtagaccgacgaatacccacaca

SEQ ID NO: 4140 - DNA, 38 bp, Artificial Sequence
  Synthetic oligonucleotide
tactggagggctacaacctgctacatagatacacatga

SEQ ID NO: 4141 - DNA, 37 bp, Artificial Sequence
  Synthetic oligonucleotide
tataacgccctaacatattgactacgagagactggga

SEQ ID NO: 4142 - DNA, 36 bp, Artificial Sequence
  Synthetic oligonucleotide
tcaatatcccgtcctcggggctagttatagtctaaa

SEQ ID NO: 4143 - DNA, 37 bp, Artificial Sequence
  Synthetic oligonucleotide
tcccataataaaccctatcaagtgtagacaaacatga

SEQ ID NO: 4144 - DNA, 37 bp, Artificial Sequence
  Synthetic oligonucleotide
tcgaacccgccacaaaatacttaagtcagtcaacaga

SEQ ID NO: 4145 - DNA, 35 bp, Artificial Sequence
  Synthetic oligonucleotide
tcgcattcccgacaaaatatatactggactacttc

SEQ ID NO: 4146 - DNA, 36 bp, Artificial Sequence
  Synthetic oligonucleotide
tgaaccgttatattaccaaattagagcttagaaata

SEQ ID NO: 4147 - DNA, 38 bp, Artificial Sequence
  Synthetic oligonucleotide
tgacatactataaccggggccattaataatacacatga

SEQ ID NO: 4148 - DNA, 36 bp, Artificial Sequence
  Synthetic oligonucleotide
tgcaacgtaaaacacacaaactctaatgataccgga

SEQ ID NO: 4149 - DNA, 36 bp, Artificial Sequence
  Synthetic oligonucleotide
tgcgacaacagccattcgggaactacccgatcacca

SEQ ID NO: 4150 - DNA, 36 bp, Artificial Sequence
  Synthetic oligonucleotide
ttccggctataatacaaacatatcacccgacttgaa

SEQ ID NO: 4151 - DNA, 7 bp, Artificial Sequence
  Synthetic oligonucleotide
acaatcc

SEQ ID NO: 4152 - DNA, 38 bp, Artificial Sequence
  Synthetic oligonucleotide
actatagaacaatccaccgctttaaatcaactatctga

SEQ ID NO: 4153 - DNA, 38 bp, Artificial Sequence
  Synthetic oligonucleotide
actatagaacaatccaccgctttaaatcaactatctca

SEQ ID NO: 4154 - DNA, 38 bp, Artificial Sequence
  Synthetic oligonucleotide
actatagaacaatccaccgctttaaatcaactatctaa

SEQ ID NO: 4155 - DNA, 38 bp, Artificial Sequence
  Synthetic oligonucleotide
actatagaacaatccaccgctttaaataaactatctga

SEQ ID NO: 4156 - DNA, 38 bp, Artificial Sequence
  Synthetic oligonucleotide
actatagaacaatccacctctttaaatcaactatctga

SEQ ID NO: 4157 - DNA, 38 bp, Artificial Sequence
  Synthetic oligonucleotide
actatagaacaatccaccgctttaaatcaactatccga

SEQ ID NO: 4158 - DNA, 38 bp, Artificial Sequence
  Synthetic oligonucleotide
aatatagaacaatccaccgctttaaatcaactatctga

SEQ ID NO: 4159 - DNA, 38 bp, Artificial Sequence
  Synthetic oligonucleotide
actatagaacaatccaccgctttaaatcaactatccta

SEQ ID NO: 4160 - DNA, 38 bp, Artificial Sequence
  Synthetic oligonucleotide
actatagaacaatccacctctttaaatcaactatctta

SEQ ID NO: 4161 - DNA, 38 bp, Artificial Sequence
  Synthetic oligonucleotide
actatagaacaatcccccgctttaaatcaactatctga

SEQ ID NO: 4162 - DNA, 38 bp, Artificial Sequence
  Synthetic oligonucleotide
actatagaacaatccgccgctttaaatcaactatctga

SEQ ID NO: 4163 - DNA, 38 bp, Artificial Sequence
  Synthetic oligonucleotide
actatagaacaatcctccgctttaaatcaactatctga

SEQ ID NO: 4164 - DNA, 38 bp, Artificial Sequence
  Synthetic oligonucleotide
actatataacaatccaccgctttaaatcaactatctga

SEQ ID NO: 4165 - DNA, 38 bp, Artificial Sequence
  Synthetic oligonucleotide
tacccctgacaatcctcgcgccgaggcctccatcctaa

SEQ ID NO: 4166 - DNA, 38 bp, Artificial Sequence; identical to SEQ ID NO: 4165
  Synthetic oligonucleotide

SEQ ID NO: 4167 - DNA, 36 bp, Artificial Sequence
  Synthetic oligonucleotide
gattttaaaacccttgcacctgattgtgccaatcaa

SEQ ID NO: 4168 - DNA, 36 bp, Artificial Sequence
  Synthetic oligonucleotide
gattttaaaacccttgcacctgattgtgccaatcga

SEQ ID NO: 4169 - DNA, 36 bp, Artificial Sequence
  Synthetic oligonucleotide
gattttaaaacccttgcacctgattgtgccaatcta

SEQ ID NO: 4170 - DNA, 36 bp, Artificial Sequence
  Synthetic oligonucleotide
aacccaattcacatacactctcaccctcactaaaca

SEQ ID NO: 4171 - DNA, 36 bp, Artificial Sequence
  Synthetic oligonucleotide
aacccaattcacatacactctcaccctcactaaaaa

SEQ ID NO: 4172 - DNA, 36 bp, Artificial Sequence
  Synthetic oligonucleotide
aacccaattcacatacactctcaccctcactaaaga

SEQ ID NO: 4173 - DNA, 36 bp, Artificial Sequence
  Synthetic oligonucleotide
aacccaattcacatacactctcaccctcactaaata

SEQ ID NO: 4174 - DNA, 36 bp, Artificial Sequence
  Synthetic oligonucleotide
aacccaattcacatacactctcaccctcactaacca

SEQ ID NO: 4175 - DNA, 36 bp, Artificial Sequence
  Synthetic oligonucleotide
aacccaattcacatacactctcaccctcactaacaa

SEQ ID NO: 4176 - DNA, 36 bp, Artificial Sequence
  Synthetic oligonucleotide
aacccaattcacatacactctctccctcactaaaca

SEQ ID NO: 4177 - DNA, 36 bp, Artificial Sequence
  Synthetic oligonucleotide
aacccaattcacatacactctccccctcactaaaca

SEQ ID NO: 4178 - DNA, 36 bp, Artificial Sequence
  Synthetic oligonucleotide
aacccaattcacatacactctcgccctcactaaaca

SEQ ID NO: 4179 - DNA, 36 bp, Artificial Sequence; identical to SEQ ID NO: 2056
  Synthetic oligonucleotide

SEQ ID NO: 4180 - DNA, 36 bp, Artificial Sequence
  Synthetic oligonucleotide
aacccaattcacataaactctcaccctcactaaaca

SEQ ID NO: 4181 - DNA, 36 bp, Artificial Sequence
  Synthetic oligonucleotide
aacccaatccacatacactctcaccctcactaaaca

SEQ ID NO: 4182 - DNA, 36 bp, Artificial Sequence
  Synthetic oligonucleotide
aacccaattcacatacactctcaccctcactaaacc

SEQ ID NO: 4183 - DNA, 36 bp, Artificial Sequence
  Synthetic oligonucleotide
aacccaattcacatacgctctcaccctcactaaaca

SEQ ID NO: 4184 - DNA, 36 bp, Artificial Sequence
  Synthetic oligonucleotide
aacccaattcacatacactctctccctcactaaaaa

SEQ ID NO: 4185 - DNA, 36 bp, Artificial Sequence
  Synthetic oligonucleotide
aacccaattcacataccctctcaccctcactaaaca

SEQ ID NO: 4186 - DNA, 36 bp, Artificial Sequence
  Synthetic oligonucleotide
aacccaattcacatacactctcgccctcactaaaaa

SEQ ID NO: 4187 - DNA, 36 bp, Artificial Sequence
  Synthetic oligonucleotide
aacccaattcacatacactcttaccctcactaaaca

SEQ ID NO: 4188 - DNA, 36 bp, Artificial Sequence
  Synthetic oligonucleotide
aacccaatacacatacactctcaccctcactaaaca

SEQ ID NO: 4189 - DNA, 36 bp, Artificial Sequence
  Synthetic oligonucleotide
aacccaattcacatacactctcaccctctctaaaca

SEQ ID NO: 4190 - DNA, 36 bp, Artificial Sequence
  Synthetic oligonucleotide
aacccaattcacatacactctccccctcactaaaaa

SEQ ID NO: 4191 - DNA, 36 bp, Artificial Sequence
  Synthetic oligonucleotide
aacccaattcacataccctctcaccctcactaaaaa

SEQ ID NO: 4192 - DNA, 36 bp, Artificial Sequence
  Synthetic oligonucleotide
aacccaattcacatacactctcaccctcactaaact

SEQ ID NO: 4193 - DNA, 36 bp, Artificial Sequence
  Synthetic oligonucleotide
aacccaattcacatacaccctcaccctcactaaaca

SEQ ID NO: 4194 - DNA, 36 bp, Artificial Sequence
  Synthetic oligonucleotide
aacccaattcacatactctctcaccctcactaaaaa

SEQ ID NO: 4195 - DNA, 36 bp, Artificial Sequence
  Synthetic oligonucleotide
aacccaatgcacatacactctcaccctcactaaaca

SEQ ID NO: 4196 - DNA, 36 bp, Artificial Sequence
  Synthetic oligonucleotide
agcccaattcacatacactctcaccctcactaaaca

SEQ ID NO: 4197 - DNA, 36 bp, Artificial Sequence
  Synthetic oligonucleotide
aacccaattcacatacactctaaccctcactaaaca

SEQ ID NO: 4198 - DNA, 36 bp, Artificial Sequence
  Synthetic oligonucleotide
aacccaaatcacatacactctcaccctcactaaaca

SEQ ID NO: 4199 - DNA, 36 bp, Artificial Sequence
  Synthetic oligonucleotide
aacccaattcacatacactctcaccctcactaaaat

SEQ ID NO: 4200 - DNA, 36 bp, Artificial Sequence
  Synthetic oligonucleotide
aacccaattcacatacactctctccctcactaaaga

SEQ ID NO: 4201 - DNA, 36 bp, Artificial Sequence
  Synthetic oligonucleotide
aacccaattctcatacactctcaccctcactaaaca

SEQ ID NO: 4202 - DNA, 36 bp, Artificial Sequence; identical to SEQ ID NO: 1884
  Synthetic oligonucleotide

SEQ ID NO: 4203 - DNA, 36 bp, Artificial Sequence
  Synthetic oligonucleotide
aacccaactcacatacactctcaccctcactaaaca

SEQ ID NO: 4204 - DNA, 36 bp, Artificial Sequence
  Synthetic oligonucleotide
aacccaattcacatacactctcaccctcactaaaac

SEQ ID NO: 4205 - DNA, 36 bp, Artificial Sequence
  Synthetic oligonucleotide
aacccaattcacatacactctcaccctcactaacta

SEQ ID NO: 4206 - DNA, 36 bp, Artificial Sequence
  Synthetic oligonucleotide
aacccaattcacatacactctcgccctcactaaaga

SEQ ID NO: 4207 - DNA, 36 bp, Artificial Sequence
  Synthetic oligonucleotide
aacccaattcacattcactctcaccctcactaaaca

SEQ ID NO: 4208 - DNA, 36 bp, Artificial Sequence
  Synthetic oligonucleotide
aaccaaattcacatacactctcaccctcactaaaca

SEQ ID NO: 4209 - DNA, 36 bp, Artificial Sequence
  Synthetic oligonucleotide
aacccaattcacataaactctcaccctcactaaaaa

SEQ ID NO: 4210 - DNA, 36 bp, Artificial Sequence
  Synthetic oligonucleotide
aacccaattcacatacacgctcaccctcactaaaca

SEQ ID NO: 4211 - DNA, 36 bp, Artificial Sequence
  Synthetic oligonucleotide
aacccaattcacatacactctcacactcactaaaca

SEQ ID NO: 4212 - DNA, 36 bp, Artificial Sequence
  Synthetic oligonucleotide
aacccaattcacatacactctcaccatcactaaaca

SEQ ID NO: 4213 - DNA, 36 bp, Artificial Sequence
  Synthetic oligonucleotide
aacccaattcacatacactctcaccctcactaacga

SEQ ID NO: 4214 - DNA, 36 bp, Artificial Sequence
  Synthetic oligonucleotide
aacccaattcacatacactctcaccctcgctaaaca

SEQ ID NO: 4215 - DNA, 36 bp, Artificial Sequence
  Synthetic oligonucleotide
aacccaattcacatacactctccccctcactaaaga

SEQ ID NO: 4216 - DNA, 36 bp, Artificial Sequence
  Synthetic oligonucleotide
aacccaattcgcatacactctcaccctcactaaaca

SEQ ID NO: 4217 - DNA, 36 bp, Artificial Sequence
  Synthetic oligonucleotide
aacccaattcacatacactcacaccctcactaaaca

SEQ ID NO: 4218 - DNA, 36 bp, Artificial Sequence
  Synthetic oligonucleotide
aacccaattcacatacactcccaccctcactaaaca

SEQ ID NO: 4219 - DNA, 36 bp, Artificial Sequence
  Synthetic oligonucleotide
aacccaattcacatacactctcaccctcactaaacg

SEQ ID NO: 4220 - DNA, 36 bp, Artificial Sequence
  Synthetic oligonucleotide
aacccaattcacatactctctcaccctcactaaaga

SEQ ID NO: 4221 - DNA, 36 bp, Artificial Sequence
  Synthetic oligonucleotide
aacccaattcacatactctctcaccctcactaaata

SEQ ID NO: 4222 - DNA, 36 bp, Artificial Sequence
  Synthetic oligonucleotide
aacccagttcacatacactctcaccctcactaaaca

SEQ ID NO: 4223 - DNA, 36 bp, Artificial Sequence
  Synthetic oligonucleotide
aaaccaattcacatacactctcaccctcactaaaca

SEQ ID NO: 4224 - DNA, 36 bp, Artificial Sequence
  Synthetic oligonucleotide
aacacaattcacatacactctcaccctcactaaaca

SEQ ID NO: 4225 - DNA, 36 bp, Artificial Sequence
  Synthetic oligonucleotide
aacccaactcacatacactctcaccctcactaaaaa

SEQ ID NO: 4226 - DNA, 36 bp, Artificial Sequence
  Synthetic oligonucleotide
aacccaagtcacatacactctcaccctcactaaaca

SEQ ID NO: 4227 - DNA, 36 bp, Artificial Sequence
  Synthetic oligonucleotide
aacccaatccacatacactctcaccctcactaaaaa

SEQ ID NO: 4228 - DNA, 36 bp, Artificial Sequence
  Synthetic oligonucleotide
aacccaattaacatacactctcaccctcactaaaca

SEQ ID NO: 4229 - DNA, 36 bp, Artificial Sequence
  Synthetic oligonucleotide
aacccaattcacaaacactctcaccctcactaaaca

SEQ ID NO: 4230 - DNA, 36 bp, Artificial Sequence
  Synthetic oligonucleotide
aacccaattcacacacactctcacccccactaaaca

SEQ ID NO: 4231 - DNA, 36 bp, Artificial Sequence
  Synthetic oligonucleotide
aacccaattcacacacactctcaccctcactaaaca

SEQ ID NO: 4232 - DNA, 36 bp, Artificial Sequence
  Synthetic oligonucleotide
aacccaattcacacacactctccccctcactaaaca

SEQ ID NO: 4233 - DNA, 36 bp, Artificial Sequence
  Synthetic oligonucleotide
aacccaattcacagacactctcaccctcactaaaca

SEQ ID NO: 4234 - DNA, 36 bp, Artificial Sequence
  Synthetic oligonucleotide
aacccaattcacatacaatctcaccctcactaaaca

SEQ ID NO: 4235 - DNA, 36 bp, Artificial Sequence
  Synthetic oligonucleotide
aacccaattcacatacacactcaccctcactaaaca

SEQ ID NO: 4236 - DNA, 36 bp, Artificial Sequence
  Synthetic oligonucleotide
aacccaattcacatacaccctcaccctcactaaaaa

SEQ ID NO: 4237 - DNA, 36 bp, Artificial Sequence
  Synthetic oligonucleotide
aacccaattcacatacactatcaccctcactaaaaa

SEQ ID NO: 4238 - DNA, 36 bp, Artificial Sequence
  Synthetic oligonucleotide
aacccaattcacatacactatcaccctcactaaaca

SEQ ID NO: 4239 - DNA, 36 bp, Artificial Sequence
  Synthetic oligonucleotide
aacccaattcacatacactcccaccctcactaaaaa

SEQ ID NO: 4240 - DNA, 36 bp, Artificial Sequence
  Synthetic oligonucleotide
aacccaattcacatacactcgcaccctcactaaaca

SEQ ID NO: 4241 - DNA, 36 bp, Artificial Sequence
  Synthetic oligonucleotide
aacccaattcacatacactctcaacctcactaaaca

SEQ ID NO: 4242 - DNA, 36 bp, Artificial Sequence
  Synthetic oligonucleotide
aacccaattcacatacactctcacactcactaaaaa

SEQ ID NO: 4243 - DNA, 36 bp, Artificial Sequence
  Synthetic oligonucleotide
aacccaattcacatacactctcaccatccctaaaca

SEQ ID NO: 4244 - DNA, 36 bp, Artificial Sequence; identical to SEQ ID NO: 2360
  Synthetic oligonucleotide

SEQ ID NO: 4245 - DNA, 36 bp, Artificial Sequence
  Synthetic oligonucleotide
aacccaattcacatacactctcacccgcactaaaca

SEQ ID NO: 4246 - DNA, 36 bp, Artificial Sequence
  Synthetic oligonucleotide
aacccaattcacatacactctcaccctaactaaaca

SEQ ID NO: 4247 - DNA, 36 bp, Artificial Sequence
  Synthetic oligonucleotide
aacccaattcacatacactctcaccctcaataaaca

SEQ ID NO: 4248 - DNA, 36 bp, Artificial Sequence
  Synthetic oligonucleotide
aacccaattcacatacactctcaccctcaccaaaca

SEQ ID NO: 4249 - DNA, 36 bp, Artificial Sequence
  Synthetic oligonucleotide
aacccaattcacatacactctcaccctcactaaaag

SEQ ID NO: 4250 - DNA, 36 bp, Artificial Sequence
  Synthetic oligonucleotide
aacccaattcacatacactctcaccctcactaaagc

SEQ ID NO: 4251 - DNA, 36 bp, Artificial Sequence
  Synthetic oligonucleotide
aacccaattcacatacactctcaccctcactaaagt

SEQ ID NO: 4252 - DNA, 36 bp, Artificial Sequence
  Synthetic oligonucleotide
aacccaattcacatacactctcaccctcactaaatc

SEQ ID NO: 4253 - DNA, 36 bp, Artificial Sequence
  Synthetic oligonucleotide
aacccaattcacatacactctcaccctcactaaatt

SEQ ID NO: 4254 - DNA, 36 bp, Artificial Sequence
  Synthetic oligonucleotide
aacccaattcacatacactctcaccctcactaagaa

SEQ ID NO: 4255 - DNA, 36 bp, Artificial Sequence
  Synthetic oligonucleotide
aacccaattcacatacactctcaccctcactaagca

SEQ ID NO: 4256 - DNA, 36 bp, Artificial Sequence
  Synthetic oligonucleotide
aacccaattcacatacactctcaccctcactaagga

SEQ ID NO: 4257 - DNA, 36 bp, Artificial Sequence
  Synthetic oligonucleotide
aacccaattcacatacactctcaccctcactaagta

SEQ ID NO: 4258 - DNA, 36 bp, Artificial Sequence
  Synthetic oligonucleotide
aacccaattcacatacactctcaccctcactaataa

SEQ ID NO: 4259 - DNA, 36 bp, Artificial Sequence
  Synthetic oligonucleotide
aacccaattcacatacactctcaccctcactaatca

SEQ ID NO: 4260 - DNA, 36 bp, Artificial Sequence
  Synthetic oligonucleotide
aacccaattcacatacactctcaccctcactaatga

SEQ ID NO: 4261 - DNA, 36 bp, Artificial Sequence
  Synthetic oligonucleotide
aacccaattcacatacactctcaccctcactaatta

SEQ ID NO: 4262 - DNA, 36 bp, Artificial Sequence
  Synthetic oligonucleotide
aacccaattcacatacactctcaccctcactacaca

SEQ ID NO: 4263 - DNA, 36 bp, Artificial Sequence
  Synthetic oligonucleotide
aacccaattcacatacactctcaccctcactagaca

SEQ ID NO: 4264 - DNA, 36 bp, Artificial Sequence
  Synthetic oligonucleotide
aacccaattcacatacactctcaccctcactataca

SEQ ID NO: 4265 - DNA, 36 bp, Artificial Sequence
  Synthetic oligonucleotide
aacccaattcacatacactctcaccctcactcaaca

SEQ ID NO: 4266 - DNA, 36 bp, Artificial Sequence
  Synthetic oligonucleotide
aacccaattcacatacactctcaccctcactgaaca

SEQ ID NO: 4267 - DNA, 36 bp, Artificial Sequence
  Synthetic oligonucleotide
aacccaattcacatacactctcaccctcacttaaca

SEQ ID NO: 4268 - DNA, 36 bp, Artificial Sequence
  Synthetic oligonucleotide
aacccaattcacatacactctcaccctcattaaaca

SEQ ID NO: 4269 - DNA, 36 bp, Artificial Sequence
  Synthetic oligonucleotide
aacccaattcacatacactctcaccctccctaaaaa

SEQ ID NO: 4270 - DNA, 36 bp, Artificial Sequence
  Synthetic oligonucleotide
aacccaattcacatacactctcaccctccctaaaca

SEQ ID NO: 4271 - DNA, 36 bp, Artificial Sequence
  Synthetic oligonucleotide
aacccaattcacatacactctcaccctccctaaaga

SEQ ID NO: 4272 - DNA, 36 bp, Artificial Sequence
  Synthetic oligonucleotide
aacccaattcacatacactctcaccctccctaaata

SEQ ID NO: 4273 - DNA, 36 bp, Artificial Sequence
  Synthetic oligonucleotide
aacccaattcacatacactctcaccctcgctaaaaa

SEQ ID NO: 4274 - DNA, 36 bp, Artificial Sequence
  Synthetic oligonucleotide
aacccaattcacatacactctcaccctctctaaaaa

SEQ ID NO: 4275 - DNA, 36 bp, Artificial Sequence
  Synthetic oligonucleotide
aacccaattcacatacactctcaccctgactaaaca

SEQ ID NO: 4276 - DNA, 36 bp, Artificial Sequence
  Synthetic oligonucleotide
aacccaattcacatacactctcacccttactaaaca

SEQ ID NO: 4277 - DNA, 36 bp, Artificial Sequence
  Synthetic oligonucleotide
aacccaattcacatacactctcaccttcactaaaca

SEQ ID NO: 4278 - DNA, 36 bp, Artificial Sequence
  Synthetic oligonucleotide
aacccaattcacatacactctcaccttctctaaaca

SEQ ID NO: 4279 - DNA, 36 bp, Artificial Sequence
  Synthetic oligonucleotide
aacccaattcacatacactctcacgctcactaaaca

SEQ ID NO: 4280 - DNA, 36 bp, Artificial Sequence
  Synthetic oligonucleotide
aacccaattcacatacactctcactctcactaaaaa

SEQ ID NO: 4281 - DNA, 36 bp, Artificial Sequence
  Synthetic oligonucleotide
aacccaattcacatacactctcactctcactaaaca

SEQ ID NO: 4282 - DNA, 36 bp, Artificial Sequence
  Synthetic oligonucleotide
aacccaattcacatacactctcagcctcactaaaca

SEQ ID NO: 4283 - DNA, 36 bp, Artificial Sequence
  Synthetic oligonucleotide
aacccaattcacatacactctcatcctcactaaaca

SEQ ID NO: 4284 - DNA, 36 bp, Artificial Sequence
  Synthetic oligonucleotide
aacccaattcacatacactctccccctcactaaata

SEQ ID NO: 4285 - DNA, 36 bp, Artificial Sequence
  Synthetic oligonucleotide
aacccaattcacatacactctcgccctcactaaata

SEQ ID NO: 4286 - DNA, 36 bp, Artificial Sequence
  Synthetic oligonucleotide
aacccaattcacatacactctctccctcactaaata

SEQ ID NO: 4287 - DNA, 36 bp, Artificial Sequence
  Synthetic oligonucleotide
aacccaattcacatacactgtcaccctcactaaaca

SEQ ID NO: 4288 - DNA, 36 bp, Artificial Sequence
  Synthetic oligonucleotide
aacccaattcacatacactttcaccctcactaaaca

SEQ ID NO: 4289 - DNA, 36 bp, Artificial Sequence
  Synthetic oligonucleotide
aacccaattcacatacattctcaccctcactaaaca

SEQ ID NO: 4290 - DNA, 36 bp, Artificial Sequence
  Synthetic oligonucleotide
aacccaattcacataccctctcaccctcactaaaga

SEQ ID NO: 4291 - DNA, 36 bp, Artificial Sequence
  Synthetic oligonucleotide
aacccaattcacatacgctctcaccctcactaaaaa

SEQ ID NO: 4292 - DNA, 36 bp, Artificial Sequence
  Synthetic oligonucleotide
aacccaattcacatacgctctcaccctcactaaaga

SEQ ID NO: 4293 - DNA, 36 bp, Artificial Sequence
  Synthetic oligonucleotide
aacccaattcacatatactctcaccctcactaaaaa

SEQ ID NO: 4294 - DNA, 36 bp, Artificial Sequence
  Synthetic oligonucleotide
aacccaattcacatatactctcaccctcactaaaca

SEQ ID NO: 4295 - DNA, 36 bp, Artificial Sequence
  Synthetic oligonucleotide
aacccaattcacatccactctcaccctcactaaaca

SEQ ID NO: 4296 - DNA, 36 bp, Artificial Sequence
  Synthetic oligonucleotide
aacccaattcacatgcactctcaccctcactaaaca

SEQ ID NO: 4297 - DNA, 36 bp, Artificial Sequence
  Synthetic oligonucleotide
aacccaattcacctacactctcaccctcactaaaaa

SEQ ID NO: 4298 - DNA, 36 bp, Artificial Sequence
  Synthetic oligonucleotide
aacccaattcacctacactctcaccctcactaaaca

SEQ ID NO: 4299 - DNA, 36 bp, Artificial Sequence
  Synthetic oligonucleotide
aacccaattcacgtacactctcaccctcactaaaca

SEQ ID NO: 4300 - DNA, 36 bp, Artificial Sequence
  Synthetic oligonucleotide
aacccaattcacttacactctcaccctcactaaaca

SEQ ID NO: 4301 - DNA, 36 bp, Artificial Sequence
  Synthetic oligonucleotide
aacccaattcagatacactctcaccctcactaaaca

SEQ ID NO: 4302 - DNA, 36 bp, Artificial Sequence
  Synthetic oligonucleotide
aacccaattcatatacactctcaccctcactaaaaa

SEQ ID NO: 4303 - DNA, 36 bp, Artificial Sequence
  Synthetic oligonucleotide
aacccaattcatatacactctcaccctcactaaaca

SEQ ID NO: 4304 - DNA, 36 bp, Artificial Sequence
  Synthetic oligonucleotide
aacccaattcccatacactctcaccctcactaaaca

SEQ ID NO: 4305 - DNA, 36 bp, Artificial Sequence
  Synthetic oligonucleotide
aacccaatttacatacactctcaccctcactaaaca

SEQ ID NO: 4306 - DNA, 36 bp, Artificial Sequence
  Synthetic oligonucleotide
aacccacttcacatacactctcaccctcactaaaca

SEQ ID NO: 4307 - DNA, 36 bp, Artificial Sequence
  Synthetic oligonucleotide
aacccatttcacatacactctcaccctcactaaaca

SEQ ID NO: 4308 - DNA, 36 bp, Artificial Sequence
  Synthetic oligonucleotide
aaccccattcacatacactctcaccctcactaaaaa

SEQ ID NO: 4309 - DNA, 36 bp, Artificial Sequence
  Synthetic oligonucleotide
aaccccattcacatacactctcaccctcactaaaca

SEQ ID NO: 4310 - DNA, 36 bp, Artificial Sequence
  Synthetic oligonucleotide
aacccgattcacatacactctcaccctcactaaaca

SEQ ID NO: 4311 - DNA, 36 bp, Artificial Sequence
  Synthetic oligonucleotide
aaccctattcacatacactctcaccctcactaaaaa

SEQ ID NO: 4312 - DNA, 36 bp, Artificial Sequence
  Synthetic oligonucleotide
aaccctattcacatacactctcaccctcactaaaca

SEQ ID NO: 4313 - DNA, 36 bp, Artificial Sequence
  Synthetic oligonucleotide
aaccgaattcacatacactctcaccctcactaaaca

SEQ ID NO: 4314 - DNA, 36 bp, Artificial Sequence
  Synthetic oligonucleotide
aacctaattcacatacactctcaccctcactaaaaa

SEQ ID NO: 4315 - DNA, 36 bp, Artificial Sequence
  Synthetic oligonucleotide
aacctaattcacatacactctcaccctcactaaaca

SEQ ID NO: 4316 - DNA, 36 bp, Artificial Sequence
  Synthetic oligonucleotide
aactcaattcacatacactctcaccctcactaaaca

SEQ ID NO: 4317 - DNA, 36 bp, Artificial Sequence
  Synthetic oligonucleotide
aatccaattcacatacactctcaccctcactaaaca

SEQ ID NO: 4318 - DNA, 36 bp, Artificial Sequence
  Synthetic oligonucleotide
accccaattcacatacactctcaccctcactaaaaa

SEQ ID NO: 4319 - DNA, 36 bp, Artificial Sequence
  Synthetic oligonucleotide
accccaattcacatacactctcaccctcactaaaca

SEQ ID NO: 4320 - DNA, 36 bp, Artificial Sequence
  Synthetic oligonucleotide
agcccaattcacatacactctcaccctcactaaaaa

SEQ ID NO: 4321 - DNA, 36 bp, Artificial Sequence
  Synthetic oligonucleotide
atcccaattcacatacactctcaccctcactaaaaa

SEQ ID NO: 4322 - DNA, 36 bp, Artificial Sequence
  Synthetic oligonucleotide
cacccaattcacatacactctcaccctcactaaaaa

SEQ ID NO: 4323 - DNA, 36 bp, Artificial Sequence
  Synthetic oligonucleotide
cacccaattcacatacactctcaccctcactaaaca

SEQ ID NO: 4324 - DNA, 36 bp, Artificial Sequence
  Synthetic oligonucleotide
gacccaattcacatacactctcaccctcactaaaca

SEQ ID NO: 4325 - DNA, 36 bp, Artificial Sequence
  Synthetic oligonucleotide
tacccaattcacatacactctcaccctcactaaaca

SEQ ID NO: 4326 - DNA, 39 bp, Artificial Sequence
  Synthetic oligonucleotide
ttaagatagttgatttaaagcggtggattgttctatagt

SEQ ID NO: 4327 - DNA, 39 bp, Artificial Sequence
  Synthetic oligonucleotide
tactatagatggattgtccgctttaaatcaactatctta

SEQ ID NO: 4328 - DNA, 91 bp, Artificial Sequence
  Synthetic oligonucleotide
ctagcatgactgcagtacgtactatagaacaatccaccgctttaaatcaactatcttactgtctcttatacacatctgacgctgccgacga

SEQ ID NO: 4329 - DNA, 46 bp, Artificial Sequence
  Synthetic oligonucleotide
acgtactatagaacaatccaccgctttaaatcaactatcttactgt

SEQ ID NO: 4330 - DNA, 41 bp, Artificial Sequence
  Synthetic oligonucleotide
gtactatagaacaatccaccgctttaaatcaactatcttac

SEQ ID NO: 4331 - DNA, 91 bp, Artificial Sequence
  Synthetic oligonucleotide
ctagcatgactgcagtacgtacgatagaacaatccaccgctttaaatcaactatcttactgtctcttatacacatctgacgctgccgacga

SEQ ID NO: 4332 - DNA, 46 bp, Artificial Sequence
  Synthetic oligonucleotide
acgtacgatagaacaatccaccgctttaaatcaactatcttactgt

SEQ ID NO: 4333 - DNA, 91 bp, Artificial Sequence
  Synthetic oligonucleotide
ctagcatgactgcagtacgtactatagaacaatccaccgctttaaatcaactatctgactgtctcttatacacatctgacgctgccgacga

SEQ ID NO: 4334 - DNA, 53 bp, Artificial Sequence
  Synthetic oligonucleotide
atagaacaatccaccgctttaaatcaactatctgactgtctcttatacacatc

SEQ ID NO: 4335 - DNA, 89 bp, Artificial Sequence
  Synthetic oligonucleotide
ctagcatgactgcagtacgtaacccaattcacatacactctcacccccactaaacactgtctcttatacacatctgacgctgccgacga

SEQ ID NO: 4336 - DNA, 89 bp, Artificial Sequence
  Synthetic oligonucleotide
ctagcatgactgcagtacgtaacccaattcacatacactctcaccctcactaaacactgtctcttatacacatctgacgctgccgacga

SEQ ID NO: 4337 - DNA, 18 bp, Artificial Sequence
  Synthetic oligonucleotide
gtaacccaattcacatac

SEQ ID NO: 4338 - DNA, 20 bp, Artificial Sequence
  Synthetic oligonucleotide
ggtaacccaattcacatacc

SEQ ID NO: 4339 - DNA, 91 bp, Artificial Sequence
  Synthetic oligonucleotide
ctagcatgactgcagtacgttaagatagttgatttaaagcggtggattgttctatagtctgtctcttatacacatctgacgctgccgacga

SEQ ID NO: 4340 - DNA, 91 bp, Artificial Sequence
  Synthetic oligonucleotide
ctagcatgactgcagtacgttacccctgacaatcctcgcgccgaggcctccatcctgactgtctcttatacacatctgacgctgccgacga

SEQ ID NO: 4341 - DNA, 91 bp, Artificial Sequence
  Synthetic oligonucleotide
ctagcatgactgcagtacgttacccctgacaatcctcgcgccgaggcctccatcctcactgtctcttatacacatctgacgctgccgacga

SEQ ID NO: 4342 - DNA, 89 bp, Artificial Sequence
  Synthetic oligonucleotide
ctagcatgactgcagtacgtgattttaaaacccttgcacctgattgtgccaatccactgtctcttatacacatctgacgctgccgacga

SEQ ID NO: 4343 - protein, 13 aa, Homo sapiens
PGRRGRPGLKGEQ

SEQ ID NO: 4344 - protein, 13 aa, Homo sapiens
RGRPGLKGEQGEP

SEQ ID NO: 4345 - protein, 13 aa, Homo sapiens
KGEQGEPGAPGIR

SEQ ID NO: 4346 - protein, 13 aa, Homo sapiens
QGEPGAPGIRTGI

SEQ ID NO: 4347 - protein, 13 aa, Homo sapiens
TGIQGLKGDQGEP

SEQ ID NO: 4348 - protein, 13 aa, Homo sapiens
KGDQGEPGPSGNP

SEQ ID NO: 4349 - protein, 13 aa, Homo sapiens
DQGEPGPSGNPGK

SEQ ID NO: 4350 - protein, 13 aa, Homo sapiens
PGPSGNPGKVGYP

SEQ ID NO: 4351 - protein, 13 aa, Homo sapiens
PSGNPGKVGYPGP

SEQ ID NO: 4352 - protein, 13 aa, Homo sapiens
PGKVGYPGPSGPL

SEQ ID NO: 4353 - protein, 13 aa, Homo sapiens
KVGYPGPSGPLGA

SEQ ID NO: 4354 - protein, 13 aa, Homo sapiens
KGTKGSPGNIKDQ

SEQ ID NO: 4355 - protein, 13 aa, Homo sapiens
IRRNPPMGGNVVI

SEQ ID NO: 4356 - protein, 13 aa, Homo sapiens
QVVSGGMVLQLQQ

What is claimed is:

1. An oligonucleotide comprising a sequence that is at least 95 percent identical to the full length of an oligonucleotide sequence selected from anyone of SEQ ID NOs. 1472, 1475, 1477, 1482, and 4152-4157, and binds C1q.

2. The oligonucleotide of claim 1, further comprising a 5' region with sequence 5'-CTAGCATGACTGCAGTACGT (SEQ ID NO. 131), a 3' region with sequence 5'-CTGTCTCTTATACACATCTGACGCTGCCGACGA (SEQ ID NO. 132), or both.

3. The oligonucleotide of claim 1, comprising a sequence selected from any one of SEQ ID NOs. 1472, 1475, 1477, 1482, and 4152-4157.

4. The oligonucleotide according to claim 3 wherein the oligonucleotide comprises at least one of DNA, RNA, PNA, and any combination thereof.

5. The oligonucleotide according to claim 3, wherein the oligonucleotide comprises at least one functional modification selected from the group consisting of biotinylation, a non-naturally occurring nucleotide, a deletion, an insertion, an addition, and a chemical modification.

6. The oligonucleotide according to claim 5, wherein the chemical modification comprises at least one of C18, polyethylene glycol (PEG), PEG4, PEG6, PEG8, and PEG12.

7. A method comprising contacting a biological sample with the oligonucleotide of claim 3.

8. The method of claim 7, further comprising detecting a presence or level of complement protein complex C1q or a subunit thereof in the biological sample that is bound by the at least one oligonucleotide or at least one member of the plurality of oligonucleotides, wherein the presence or level is used to characterize a phenotype, wherein the phenotype is a disease or disorder, wherein the characterizing comprises comparing the presence or level to a reference.

9. The method of claim 8, wherein the detecting comprises at least one of sequencing, amplification, hybridization, gel electrophoresis, chromatography, and any combination thereof.

10. The method of claim 9, wherein the sequencing comprises at least one of next generation sequencing, dye termination sequencing, pyrosequencing, and any combination thereof.

11. The method of claim 8, wherein the detecting comprises using at least one of an immunoassay, enzyme immunoassay (EIA), enzyme-linked immunosorbent assay (ELISA), enzyme-linked oligonucleotide assay (ELONA), affinity isolation, immunoprecipitation, Western blot, gel electrophoresis, or flow cytometry.

12. The method of claim 7, wherein the biological sample comprises a bodily fluid, tissue sample or cell culture.

13. The method of claim 8, wherein the reference comprises the presence or level determined in a sample from at least one individual without the phenotype or from at least one individual with a different phenotype.

14. The method of claim 8, wherein the sample is from a subject suspected of having or being predisposed to the disease or disorder.

15. The method of claim 8, wherein the disease or disorder comprises a cancer, a premalignant condition, an inflammatory disease, an immune disease, an autoimmune disease or disorder, a cardiovascular disease or disorder, neurological disease or disorder, infectious disease or pain.

16. A pharmaceutical composition comprising a therapeutically effective amount of the oligonucleotide of claim 3, or a salt thereof, and a pharmaceutically acceptable carrier, diluent, or both.

17. A method of treating or ameliorating a disease or disorder in a subject in need thereof, comprising administering the composition of claim 16 to the subject.

18. A method of inhibiting C1q in a subject, comprising administering the composition of claim 16 to the subject.

19. The method of claim 17, wherein the administering comprises at least one of intradermal, intramuscular, intraperitoneal, intravenous, subcutaneous, intranasal, epidural, oral, sublingual, intracerebral, intravaginal, transdermal, rectal, by inhalation, topical administration, or any combination thereof.

* * * * *